United States Patent 12,508,308 (INFLUENZA mRNA VACCINES) - sequence listing, part 51

SEQ ID NO: 197194 - RNA, 1410 nt, Artificial Sequence
  derived and/or modified sequence opt5 from neuraminidase__InfluenzaA__AAX56563
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcgcucuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacauucaaagugaucgagggcuggagcaagccuaauucuaaacugcagaucaaccggcaggucauuguggaacgcgacaauagauccggcuacagcgggaucuuuucugucgagggaaaguccugcauuaaccgguguuucuauguggaacucaucagaggccgcaaggaggaaaccgagguuugguggacgagcaauuccauuguggucuuuugcgggacaucuggaaccuacggcaccgggagcuggcccgauggcgccgacaucaaccugaugccuauuuga

SEQ ID NO: 197195 - RNA, 1410 nt, Artificial Sequence
  derived and/or modified sequence opt5 from neuraminidase__InfluenzaA__AAX56573
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucguccacauuagcacacuuuccgggucugcucaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggccuuugaugacggcaacgauguuuggauggggcgcaccauuagcgagaaacugagauccggauacgagaccuucaaggugaucgaaggcuggagcaaaccuaauucuaagcugcagaucaaccggcaggucauuguggagcgcggcaauagauccggguauagcggaaucuuuucugucgaaggcaaauccugcauuaaccgguguuucuacguggagcucaucagagggcgcaaggaagagacggagguuugguggacaagcaauuccauuguggucuuuugcggaaccucuggcaccuaugggacaggcagcuggcccgacggagcugauaucaaccugaugccuauuuga

SEQ ID NO: 197196 - RNA, 1410 nt, Artificial Sequence
  derived and/or modified sequence opt5 from neuraminidase__InfluenzaA__AAX56583
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgaccauuggaagggcuccaacagaccuaucgucgauauuaaugugaaggacuacagcaucguuucuuccuaugugugcagcggccuggucggggacacaccccggaaaaacgauucuuucagcuccucucacugucucgacccgaauaacgaggaaggaggccauggggugaagggaugggcuuuugaugacggcaaugauguuuggauggggcgcaccauuagcgagaaacugagauccggauacgagacguucaaggugaucgaaggcuggagcaaaccuaacucuaagcugcagacaaaucggcaggucaucguggagcgcggcaacagauccggguauagcggaaucuuuucugucgaaggcaaauccugcauuaaucgguguuucuacguggagcucauuagagggcgcaaggaagagaccgagguuugguggaccagcaacuccaucguggucuuuugcggaacaucuggcaccuaugggacaggcagcuggcccgacggagccgauauuaaucugaugccuaucuga

SEQ ID NO: 197197 - RNA, 1410 nt, Artificial Sequence
  derived and/or modified sequence opt5 from neuraminidase__InfluenzaA__AAX56593
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucgucaacauuagcacacuuuccgggucugcucaacacguugaggaaugcagcuguuauccuagauaccccggagugcggugcgugugucgcgacaauuggaagggcuccaacagaccuaucgucgauauuaaugugaaggacuacagcaucguuucuuccuaugugugcagcggccuggucggggacacaccccggaaaaacgauucuuucagcuccucucacugucucgacccgaauaacgaggaaggaggccauggggugaagggaugggccuuugaugacggcaaugauguuuggauggggcgcaccauuagcgagaaauucagauccggauacgagaccuuuaaggugaucgaaggcuggagcaaaccuaacucuaagcugcagaucaaucggcaggucauuguggagcgcggcaacagauccggguauagcggaaucuucucugucgaaggcaaauccugcauuaaucgguguuuuuacguggagcugaucagagggcgcaaggaagagacggagguuugguggacaagcaacuccauuguggucuucugcggaaccucuggcaccuaugggacaggcagcuggcccgacggagcugauaucaaucucaugccuauuuga

SEQ ID NO: 197198 - RNA, 1410 nt, Artificial Sequence
  derived and/or modified sequence opt5 from neuraminidase__InfluenzaA__AAX56603
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacagcucaugaucggaccccguaccgcacgcugcugaugaaugaacucgggguucccuuucaccugggaacaagacagguguguaucgccuggagcuccagcucuugccaugacggcaaggcuuggcuucacgucugugugaccggcgaugacaaaaacgccacagcguccuucauuuauaaugggcggcugguugauagcaucggaucuugguccaagaaaauucuccgcacccaggagagcgaaugcguguguaucaacgggaccugcacagucgugaugacggacggcucugccuccggaaaggcugauaccaaaauucuguuuaucgaggagggcaagaucgugcacauuagcacacuuuccgggucugcccaacaugucgaagagugcagcuguuacccuagauaucccggaguucggugcgugugucgcgacaacuggaagggcuccaauagaccuaucguggauauuaacgucaaagacuacagcaucgugucuuccuacguuugcagcggccuggugggggacacaccccggaagaaugauucuuucagcuccucucacugucucgacccgaacaaugaagagggaggccauggggucaaaggaugggcuuuugaugacggcaacgauguguggauggggcgcaccauuagcgaaaagcugagauccggauaugagaccuucaaaguuaucgagggcuggagcaagccuaauucuaaacugcagaucaaccgccaggugauugucgaacggggcaauagauccggguacagcggaaucuuuucuguggagggcaaguccugcauuaaccgguguuucuaugucgaacucaucagagggcgcaaggaggaaacggaggugugguggacaagcaauuccauuguuguguuuugcggaaccucuggcaccuacgggacaggcagcuggcccgacggagccgauaucaaccugaugccuauuuga

SEQ ID NO: 197199 - RNA, 1410 nt, Artificial Sequence; identical to SEQ ID NO: 197169
  derived and/or modified sequence opt5 from neuraminidase__InfluenzaA__AAX57647

SEQ ID NO: 197200 - RNA, 1410 nt, Artificial Sequence; identical to SEQ ID NO: 197159
  derived and/or modified sequence opt5 from neuraminidase__InfluenzaA__AAX57657

SEQ ID NO: 197201 - RNA, 1410 nt, Artificial Sequence; identical to SEQ ID NO: 197197
  derived and/or modified sequence opt5 from neuraminidase__InfluenzaA__AAX57667

SEQ ID NO: 197202 - RNA, 1410 nt, Artificial Sequence; identical to SEQ ID NO: 197178
  derived and/or modified sequence opt5 from neuraminidase__InfluenzaA__AAX57677

SEQ ID NO: 197203 - RNA, 1410 nt, Artificial Sequence
  derived and/or modified sequence opt5 from neuraminidase__InfluenzaA__AAX57687
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacgaugggcggcugguggacagcaucggaucuugguccaaaaagauucuccgcacccaggaaagcgagugcgucuguaucaaugggaccugcacaguggugaugacggauggcucugcguccggaaaagccgacaccaagauucuguuuaucgaggaaggcaaaaucgucaacauuagcacacuuuccgggucugcucaacacguugaggaaugcagcuguuauccuagauaccccggagugcggugcgugugucgcgauaacuggaagggcuccaauagaccuaucgucgacauuaacgugaaggacuacagcaucguuucuuccuaugugugcagcggccuggucggggauacaccccggaaaaaugacucuuucagcuccucucacugucucgauccgaacaaugaggaaggaggccauggggugaagggaugggccuuugacgauggcaacgacguuuggauggggcgcaccauuagcgagaaacugagauccggauacgagaccuucaaggugaucgaaggcuggagcaaaccuaauucuaagcugcagaucaaccggcaggucauuguggagcgcggcaauagauccggguauagcggaaucuuuucugucgaaggcaaauccugcauuaaccgguguuucuacguggagcucaucagagggcgcaaggaagagacggagguuugguggacaagcaauuccauuguggucuuuugcggaaccucuggcaccuaugggacaggcagcuggcccgauggagcugacaucaaccugaugccuauuuga

SEQ ID NO: 197204 - RNA, 1410 nt, Artificial Sequence
  derived and/or modified sequence opt5 from neuraminidase__InfluenzaA__AAX57697
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggaccauagcaucguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccauuagcgagaaacugagauccggauaugagacguucaaggugaucgaaggcuggagcaaaccuaauucuaagcugcagaucaaccggcaggucauuguggagcgcggcaauagauccggguacagcggaaucuuuucugucgaaggcaaauccugcauuaaccgguguuucuauguggagcucaucagagggcgcaaggaagagacagagguuugguggaccagcaauuccauuguggucuuuugcggaaccucuggcacauacgggaccggcagcuggcccgacggagccgauaucaaccugaugccuauuuga

SEQ ID NO: 197205 - RNA, 1410 nt, Artificial Sequence
  derived and/or modified sequence opt5 from neuraminidase__InfluenzaA__AAX57707
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugaucgcuucucuagcucccacugucucgacccgaacaaugaagagggaggccauggggugaaaggaugggccuuugaugacggcaacgauguuuggauggggagaaccauuucugaaaagcugcggagcggauaugagaccuucaaagugaucgagggcugguccaagccuaauagcaaacugcagaucaaccgccaggucauuguggaaagaggcaaucggucuggguacuccggaaucuuuagcgucgagggcaagucuugcauuaacagauguuucuauguggaacucauccgcgggcggaaggaggaaacggagguuugguggacauccaauagcauuguggucuuuugcggaaccuccggcaccuacgggacaggcucuuggcccgacggagcugauaucaaccugaugccuauuuga

SEQ ID NO: 197206 - RNA, 1410 nt, Artificial Sequence; identical to SEQ ID NO: 197178
  derived and/or modified sequence opt5 from neuraminidase__InfluenzaA__AAX57717

SEQ ID NO: 197207 - RNA, 1410 nt, Artificial Sequence; identical to SEQ ID NO: 197197
  derived and/or modified sequence opt5 from neuraminidase__InfluenzaA__AAX57726

SEQ ID NO: 197208 - RNA, 1410 nt, Artificial Sequence; identical to SEQ ID NO: 197197
  derived and/or modified sequence opt5 from neuraminidase__InfluenzaA__AAX57737

SEQ ID NO: 197209 - RNA, 1410 nt, Artificial Sequence; identical to SEQ ID NO: 197085
  derived and/or modified sequence opt5 from neuraminidase__InfluenzaA__AAX57747

SEQ ID NO: 197210 - RNA, 1410 nt, Artificial Sequence; identical to SEQ ID NO: 197085
  derived and/or modified sequence opt5 from neuraminidase__InfluenzaA__AAX57757

SEQ ID NO: 197211 - RNA, 1410 nt, Artificial Sequence
  derived and/or modified sequence opt5 from neuraminidase__InfluenzaA__AAX57767
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgaucggacgcccuaucgcacacugcugaugaaugaacucggggugccuuuucaucugggaaccaagcaggucuguaucgccuggucuagcuccagcugccacgacggcaaagccuggcuucauguguguguuacaggcgaugacgagaacgcuaccgcuucuuucauuuacaaugggagacugguggauuccaucggaagcuggucuaagaaaauucuccggacccaggaauccgagugcgucuguaucaacggcacaugcacgguggugaugaccgacgggagcgccucuggaaaggcggauacaaaaauucuguuuaucgaggaaggcaagaucguccacaccucccuucugagcggguccgcccaacacguugaggaaugcucuuguuauccccgcuacccuggagugagaugcgugugucgggacaacuggaagggcagcaaucgccccauugucgauaucaacgugaaagacuacuccauuguuagcucuuaugugugcuccggccucgucggggacacaccgagaaagaaugauagcucuagcuccucucauugucuggacccuaacaaugaggaaggaggccacggggugaaaggaugggcuuucgaugacggcaacgauguuuggauggggcggaccaucagcgagaagcugcgcuccggauacgagacguuuaaagugauugaaggcuggagcaagcccaauucuaaacuccagaucaacagacaggucaucguggaccggggcaaucgcuccggguauagcggaauuuucucugucgagggcaaguccugcaucaacagauguuuuuacguggaacugauucgggggagaaagcaggagacagaaguucuuuggaccagcaauuccaucguggucuucugcggaaccucuggcacauaugggaccggcagcuggccugauggagccgacauuaaccugaugcccaucuga

SEQ ID NO: 197212 - RNA, 1410 nt, Artificial Sequence
  derived and/or modified sequence opt5 from neuraminidase__InfluenzaA__AAX57777
augaaccccaaucagaagaucauuaccaucggcagcgugucccugauuaucgccacaauuugcuuccucaugcaaaucgcuauccuggucacgaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaacauuacgggguucgcgccuuuuuccaaagacaauucuauccgccuuagcgcuggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaaagcaggucuguauugccuggagcuccagcucuugccacgacggcaaagccuggcuucauguguguguuaccggcgaugacgagaacgcuacagcuuccuucaucuacaaugggagacugguggauagcauuggaucuugguccaagaaaauccuccggacccaggaaagcgagugcgucuguauuaacgggaccugcacaguggugaugacggacggcucugccuccggaaaggcggauaccaaaauccuguuuaucgaggaaggcaagauuguccacacaagcucccuuucugggagcgcccaacacguugaggaaugcuccuguuauccucgcuaccccggagugagaugcgugugucgggacaacuggaagggcagcaaucgcccuaucgucgauauuaacgugaaagacuacucuaucguuuccagcuaugugugcucuggccuggucggggacacccccagaaagaaugauagcuccucuagcucccauugucucgacccgaacaaugaggaaggaggccacggggugaaaggaugggcuuucgaugacggcaacgauguuuggauggggcggacaauuagcgagaagcugcgcucuggauacgagaccuuuaaagugaucgaaggcugguccaagccuaauagcaaacugcagaucaacagacaggucauuguggaccggggcaaucgcucuggguauuccggaaucuucagcgucgagggcaaguccugcauuaacagauguuuuuacguggaacucauccgggggagaaagcaggagacggaaguucuguggacaucuaauagcauuguggucuucugcggaaccuccggcaccuaugggacaggcucuuggcccgauggagccgacaucaaccuuaugccuauuuga

SEQ ID NO: 197213 - RNA, 1410 nt, Artificial Sequence
  derived and/or modified sequence opt5 from neuraminidase__InfluenzaA__AAX57787
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccaacaccaagauucuguuuaucgaggaaggcaaaaucgucaauauuagcacacuuuccgggucugcucaacacguugaggaaugcagcuguuauccuagauaccccggagugcggugcgugugucgcgauaacuggaagggcuccaauagaccuaucgucgacauuaacgugaaggauuacagcaucguuucuuccuaugugugcagcggccuggucggggacacaccccggaaaaaugacucuuucagcuccucucacugucucgauccgaacaaugaggaaggaggccauggggugaagggaugggccuuugacgauggcaacgacguuuggauggggcgcaccauuagcgagaaauucagauccggauacgagaccuuuaaggugaucgaaggcuggagcaaaccuaauucuaagcugcagaucaaccggcaggucauuguggagcgcggcaauagauccggguauagcggaaucuucucugucgaaggcaaauccugcauuaaccgguguuuuuacguggagcugaucagagggcgcaaggaagagacggagguuugguggacaagcaauuccauuguggucuucugcggaaccucuggcaccuaugggacaggcagcuggcccgauggagcugacaucaaccucaugccuauuuga

SEQ ID NO: 197214 - RNA, 1410 nt, Artificial Sequence; identical to SEQ ID NO: 197085
  derived and/or modified sequence opt5 from neuraminidase__InfluenzaA__AAX57797

SEQ ID NO: 197215 - RNA, 1410 nt, Artificial Sequence; identical to SEQ ID NO: 197085
  derived and/or modified sequence opt5 from neuraminidase__InfluenzaA__AAX57807

SEQ ID NO: 197216 - RNA, 1410 nt, Artificial Sequence
  derived and/or modified sequence opt5 from neuraminidase__InfluenzaA__AAX57817
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucucuuccuggagcaagaaaauucuccggacccaggaaucugagugcgucuguaucaacggaacaugcacgguggugaugaccgacggcuccgccagcgggaaggcggauacaaaaauucuguuuaucgaggaaggaaagaucguccacaccuccucucuuagcggcuccgcccaacacguugaggaaugcagcuguuauccucgcuaccccggggugagaugcgugugucgggacaacuggaagggaucuaaucgcccuauugucgauaucaacgugaaagacuacuccauuguuagcucuuaugugugcagcggccuggucggcgacacacccagaaagaaugauuccucuagcuccagccauugucucgacccgaacaaugaggaagggggacacggcgugaaagggugggcuuucgaugacggaaacgauguuuggaugggccggaccaucucugagaagcugcgcuccggguacgagacguuuaaagugauugaaggauggagcaagccuaauucuaaacugcagaucaacagacaggucaucguggaccggggcaaucgcuccggcuauagcgggauuuucuccgucgagggaaagucuugcaucaacagauguuuuuacguggaacucauucggggcagaaagcaggagacagaaguucuguggaccagcaauuccaucguggucuucugcgggaccucuggaacauauggcaccgggagcuggcccgauggcgccgacauuaaccuuaugccuaucuga

SEQ ID NO: 197217 - RNA, 1410 nt, Artificial Sequence; identical to SEQ ID NO: 197085
  derived and/or modified sequence opt5 from neuraminidase__InfluenzaA__AAX57837

SEQ ID NO: 197218 - RNA, 1410 nt, Artificial Sequence
  derived and/or modified sequence opt5 from neuraminidase__InfluenzaA__AAX57847
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccggggcaaucgcagcggguauucuggaauuuucuccgucgagagcaaguccugcaucaacagauguuuuuacguggaacugauucggggcagaaagcaggagacagaaguucuuuggaccucuaauagcaucguggucuucugcgggaccuccggaacauauggcaccgggucuuggcccgauggcgccgacauuaaccugaugccuaucuga

SEQ ID NO: 197219 - RNA, 1410 nt, Artificial Sequence
  derived and/or modified sequence opt5 from neuraminidase__InfluenzaA__AAX57857
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaccaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaagccuggcuucauguguguguuaccggcgaugacgagaacgcuaccgcuuccuucaucuacaaugggagacugguggauagcauuggaucuugguccaagaaaauccuccggacacaggaaagcgagugcgucuguauuaacggcacgugcaccguggugaugacagacgggucugccuccggaaaggcggauaccaaaauccuguuuauugaggaaggcaagaucguccacacaagcucccuuucugggagcgcccaacacguugaggaaugcuccuguuauccucgcuaccccggagugagaugcgugugucgggacaacuggaagggcagcaaucgcccuaucgucgauauuaacgugaaagacuacucuaucguuuccagcuaugugugcucuggccuggucggggacacccccagaaagaaugauagcuccucuagcucccauugucucgacccgaacaaugaggaaggaggccacggggugaaaggaugggcuuucgaugacggcaacgauguuuggauggggcggacgauuagcgagaagcugcgcucuggauacgagacauuuaaagugaucgaaggcugguccaagccuaauagcaaacugcagauuaacagacaggucaucguggaccggggcaaucgcucuggguauuccggaaucuucagcgucgagggcaaguccugcauuaacagauguuuuuacguggaacucauccgggggagaaagcaggagaccgaaguucuguggaccucuaauagcauuguggucuucugcggaacauccggcaccuaugggacaggcucuuggcccgauggagccgacaucaaccuuaugccuauuuga

SEQ ID NO: 197220 - RNA, 1410 nt, Artificial Sequence; identical to SEQ ID NO: 197085
  derived and/or modified sequence opt5 from neuraminidase__InfluenzaA__AAX57867

SEQ ID NO: 197221 - RNA, 1410 nt, Artificial Sequence
  derived and/or modified sequence opt5 from neuraminidase__InfluenzaA__AAX57877
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgagggcaaguccugcaucaacagauguuuuuacguggaacucauucgggggagaaagcaggagacagaaguucuguggaccucuaauagcaucguggucuucugcggaaccuccggcacauaugggaccggcucuuggcccgauggagccgacauuaaccuuaugcauaucuga

SEQ ID NO: 197222 - RNA, 1410 nt, Artificial Sequence; identical to SEQ ID NO: 197085
  derived and/or modified sequence opt5 from neuraminidase__InfluenzaA__AAX57887

SEQ ID NO: 197223 - RNA, 1410 nt, Artificial Sequence
  derived and/or modified sequence opt5 from neuraminidase__InfluenzaA__AAX57897
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgauagcggcaacgacguuuggauggggcggaccaucucugagaagcugcgcuccggauacgagacguuuaaagugauugaaggcuggagcaagccuaauucuaaacugcagaucaacagacaggucaucguggaucggggcaaucgcuccggguauagcggaauuuucuccgucgagggcaagucuugcaucaacagauguuuuuacguggaacucauucgggggagaaagcaggagacagaaguucuguggaccagcaauuccaucguggucuucugcggaaccucuggcacauaugggaccggcagcuggcccgacggagccgauauuaaccuuaugccuaucuga

SEQ ID NO: 197224 - RNA, 1410 nt, Artificial Sequence
  derived and/or modified sequence opt5 from neuraminidase__InfluenzaA__AAX57907
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaugaacagacaggucaucguggaccggggcaaucgcucuggguauuccggaaucuucagcgucgagggcaaguccugcauuaacagauguuuuuacguggaacucauccgggggagaaagcaggagacagaaguucuguggaccucuaauagcauuguggucuucugcggaaccuccggcacauaugggaccggcucuuggcccgauggagccgacaucaaccuuaugccuauuuga

SEQ ID NO: 197225 - RNA, 1410 nt, Artificial Sequence; identical to SEQ ID NO: 197085
  derived and/or modified sequence opt5 from neuraminidase__InfluenzaA__AAX57917

SEQ ID NO: 197226 - RNA, 1410 nt, Artificial Sequence; identical to SEQ ID NO: 197085
  derived and/or modified sequence opt5 from neuraminidase__InfluenzaA__AAX57927

SEQ ID NO: 197227 - RNA, 1410 nt, Artificial Sequence
  derived and/or modified sequence opt5 from neuraminidase__InfluenzaA__AAX57937
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaaugguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucaucuacaaugggagacugguggauagcauuggaucuugguccaagaaaauccuccggacccaggaaagcgagugcgucuguauuaacggcacaugcacgguggugaugaccgacgggucugccuccggaaaggcggauacaaaaauccuguuuauugaggaaggcaagaucguccacaccagccuucuguccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccauuuccgagaagcugcgcagcggauacgagacguuuaaagugaucgaaggcuggucuaagccuaauuccaaacuccagauuaacagacaggucaucguggaccggggcaaucgcagcggguauucuggaaucuucuccgucgagggcaagagcugcauuaacagauguuuuuacguggaacugauccgggggagaaagcaggagacagaaguucuuuggaccuccaauucuauuguggucuucugcggaaccagcggcacauaugggaccggcuccuggcccgauggagccgacaucaaccugaugcgcauuuga

SEQ ID NO: 197228 - RNA, 1410 nt, Artificial Sequence
  derived and/or modified sequence opt5 from neuraminidase__InfluenzaA__AAX57947
augaaccccaaucagaagaucauuaccaucggcagcguuucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuuggucccgcaaaauucucagaacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgguaccccggagugcgcugcguguguagagacaacuggaaaggcuccaaucggccuaucgucgauauuaacgugaaggacuacagcaucgcuucuuccuauaugugcagcggccugguuggggacacaccccgcaagaaugauucuuucagcuccucucauugucucgacccgaacaaugaggaaggaggccacggggugaaaggaugggccuuugaugacggcaacgaugucuggauggggagaaccauuagcgagaagcugcgguccggauacgagacguucaaagugaucgaaggcuggagcaagccuaauucuaaacugcagaucaaccgccagguuauuguggagagaggcaaucgguccggguauagcggaaucuuuucugucgaaggcaaguccugcauuaacagauguuucuacguggagcucauccgcgggcggaaagaagagacagaggucugguggaccagcaauuccauugugguguuuugcggaaccucuggcacauaugggaccggcagcuggcccgacggagcugauaucaaccugaugccuauuuga

SEQ ID NO: 197229 - RNA, 1410 nt, Artificial Sequence; identical to SEQ ID NO: 197169
  derived and/or modified sequence opt5 from neuraminidase__InfluenzaA__AAX76626

SEQ ID NO: 197230 - RNA, 1410 nt, Artificial Sequence
  derived and/or modified sequence opt5 from neuraminidase__InfluenzaA__AAX76646
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacaauaccguucaugaccggacgccguaccgcacacugcugaugaacgaacucggggugcccuuucaccugggaaccagacaggucuguaucgccuggagcuccagcggcugccaugauggcaaggcuuggcuucacguguguguuacaggggacgauaaaaaugccaccgcuucuuucauuuauaacggacggcugguggacuccaucggcagcuggucuaagaaaauucuccgcacccaggaguccgaaugcgucuguaucaacgggacaugcacgguggugaugaccgauggaagcgccucuggcaaggcggacacaaaaauucuguuuaucgaggaggggaagaucguccacauuuccacccuuagcggauccgcccaacauguugaagagugcucuuguuacccuagauaucccggcgugcggugcgugugucgcgauaauuggaagggcagcaacagaccuaucgucgacauuaaugugaaagauuacuccaucguuagcucuuacgugugcuccgggcuggucggagacacaccccggaagaacgacagcuucucuagcucccacugucucgauccgaauaacgaagagggcgggcauggagugaaaggcugggcuuuugacgaugggaaugacguuuggaugggacgcaccauuucugaaaagcugagaagcggcuaugagacguucaaagugaucgagggcugguccaagccuaacagcaaacugcagaucaaucggcaggucauuguggaacgcgggaacagaucuggauacuccggcaucuuuagcgucgaggggaagucuugcauuaaucgguguuucuauguggaacucaucagaggacgcaaggaggaaacagagguuugguggaccuccaacagcauuguggucuuuugcggcaccuccgggacauacggcaccggaucuuggcccgauggcgccgacaucaaucugaugccuauuuga

SEQ ID NO: 197231 - RNA, 1410 nt, Artificial Sequence; identical to SEQ ID NO: 197159
  derived and/or modified sequence opt5 from neuraminidase__InfluenzaA__AAX76656

SEQ ID NO: 197232 - RNA, 1410 nt, Artificial Sequence; identical to SEQ ID NO: 197204
  derived and/or modified sequence opt5 from neuraminidase__InfluenzaA__AAX76666

SEQ ID NO: 197233 - RNA, 1410 nt, Artificial Sequence; identical to SEQ ID NO: 197085
  derived and/or modified sequence opt5 from neuraminidase__InfluenzaA__AAX76696

SEQ ID NO: 197234 - RNA, 1410 nt, Artificial Sequence
  derived and/or modified sequence opt5 from neuraminidase__InfluenzaA__AAX76736
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacugagcgaguaccggaauugguccaagccccagugcaacaucaccggguucgccccuuuuucuaaagacaauagcauucgccuuuccgcgggaggcgauaucugggucacaagagagcccuaugugucuugugacccugauaagugcuaccaauucgcucuggggcagggaaccacacucaacaauggccauagcaacgacaccguucacgaucggacgccguaucgcacacugcugaugaaugaacucggggugcccuuucaucugggaaccaagcaggucuguaucgccugguccucuagcuccugccacgacggcaaagccuggcuucauguguguguuacaggcgaugacgagaacgcuaccgccagcuucauuuacaaugggagacugguggauucuaucggauccuggagcaagaaaauucuccggacccaggaaucugagugcgucuguaucaacggcacaugcacgguggugaugaccgacggguccgcuagcggaaaggccgauacaaaaauucuguuuaucgaggaaggcaagaucguccacauuuccacccuuucucgcagcgcgcaacacguugaggaaugcuccuguuauccuagauaccccggggugcggugcgugugucgcgacaacuggaagggaagcaauagaccuaucgucgauauuaacgugaaagaccauucuaucguuuccagcuacgugugcucuggccuggucggcgacacaccccggaagaaugauagcuucuccucuagccacugucucgacccgaacaaugaggaagggggacauggcgugaaagggugggccuuugaugacggaaacgauguuuggaugggccgcaccauuuccgagaagcugagaagcggguaugagacguucaaagugaucgaaggauggucuaagccuaauuccaaacugcagaucaaccggcaggucauuguggagcgcggcaauagaagcggcuacucugggaucuuuuccgucgaaggaaagagcugcauuaaccgguguuucuauguggagcucaucagaggccgcaaggaagagacagagguuugguggaccuccaauucuauuguggucuuuugcgggaccagcggaacauacggcaccggguccuggcccgacggcgcugauaucaaccugaugccuauuuga

SEQ ID NO: 197235 - RNA, 1410 nt, Artificial Sequence
  derived and/or modified sequence opt5 from neuraminidase__InfluenzaA__AAX76766
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgucggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaaguccugcauuaaccgguguuucuauguugaacucaucagagggcgcaaggaggaaacagaggugugguggaccagcaauuccauugucguguuuugcggaaccucuggcacauacgggaccggcagcuggcccgacggagcugauaucaaccugaugccuauuuga

SEQ ID NO: 197236 - RNA, 1410 nt, Artificial Sequence; identical to SEQ ID NO: 197161
  derived and/or modified sequence opt5 from neuraminidase__InfluenzaA__AAY18089

SEQ ID NO: 197237 - RNA, 1410 nt, Artificial Sequence
  derived and/or modified sequence opt5 from neuraminidase__InfluenzaA__AAY18099
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacaauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucauuuauaacgggcggcugguggacagcaucggaucuugguccaagaaaauucuccgcacccaggagagcgaaugcgucuguaucaacggcacaugcacgguggugaugaccgaugggucugccuccggaaaggcggacacaaaaauucuguuugucgaggagggcaagaucguucacaucagcacccuuuccgggucugcccaacauguggaagagugcagcuguuacccuagauaucccggagugcggugcgucugucgcgauaauuggaagggcuccaacagaccuauuguggacaucaauguuaaagauuacagcauugugucuuccuacgucugcagcggccuggugggggacacaccccggaagaacgacucuuucagcuccucucacugucucgauccgaauaacgaagagggaggccaugggguuaaaggaugggcuuuugacgauggcaaugacguguggauggggcgcaccaucagcgaaaagcugagauccggauaugagacguucaaagucauugagggcuggagcaagccuaacucuaaacugcagaucaaucgccaggugaucgucgaacggggcaacagauccggguacagcggaaucuuuucuguggagggcaaguccugcauuaaucgguguuucuauguugaacucauuagagggcgcaaggaggaaacagaggugugguggaccagcaacuccaucgucguguuuugcggaaccucuggcacauacgggaccggcagcuggcccgauggagccgacauuaaucugaugccuaucuga

SEQ ID NO: 197238 - RNA, 1410 nt, Artificial Sequence
  derived and/or modified sequence opt5 from neuraminidase__InfluenzaA__AAY18109
augaaccccaaucagaagaucauuaccaucggcagcgugucccugacaauugccacgaucugcuuccucaugcaaauugcuauccuggucaccacacuuacccugcacuuuaaacaguacgaguguaacucuccuccgaauaaccagguuaugcucugcgaacccgccaucauugagagaaauaucacagaaauuguguaucugaccaacacaaccaucgagaaggaaaaauguccuaaacuugcggaguaccggaauuggagcaagccccagugcaacauuacgggguucgcuccuuuuuccaaggacaauucuauccgccugagcgccggaggcgauauuugggugaccagagagcccuaugucuccugugacccugauaagugcuaccaauucgcccucgggcagggaacaacccugaacaauggccauucuaacgacacagugcacgaucggaccccguaucgcacgcugcucaugaaugaacuggggguucccuuucaucuuggaacaagacagguguguaucgcuuggagcuccagcucuugccacgacggcaaagccuggcugcaugucugugugaccggcgaugacgagaacgcuacagccuccuucaucuacaaugggcggcucguugauagcauuggaucuugguccaagaaaauccugcgcacccaggaaagcgagugcguguguauuaacgggaccugcacagucgugaugacggacggcucugcguccggaaaggccgauaccaaaauccuuuuuauugaggaaggcaagaucgugaacaucagcacacuguccgggucugcucaacacgucgaggaaugcagcuguuauccuagauaccccggaguucggugcgugugucgcgacaauuggaagggcuccaacagaccuauuguggauaucaaugucaaagacuacagcauugugucuuccuauguuugcagcggccucgugggggacacaccccggaagaacgauucuuucagcuccucucacugucuggacccgaauaacgaggaaggaggccauggggucaaaggaugggccuuugaugacggcaaugauguguggauggggcgcaccaucagcgagaagcugagauccggauacgagaccuucaaaguuauugaaggcuggagcaagccuaacucuaaacuccagaucaaucgccaggugaucgucgagcggggcaacagauccggguauagcggaaucuuuucuguggaaggcaaguccugcauuaaucgguguuucuacgucgagcugauuagagggcgcaaggaagagacggaggugugguggacaagcaacuccaucguuguguuuugcggaaccucuggcaccuaugggacaggcagcuggcccgacggagcugauauuaaucuuaugccuaucuga

SEQ ID NO: 197239 - RNA, 1410 nt, Artificial Sequence; identical to SEQ ID NO: 197197
  derived and/or modified sequence opt5 from neuraminidase__InfluenzaA__AAY18119

SEQ ID NO: 197240 - RNA, 1410 nt, Artificial Sequence
  derived and/or modified sequence opt5 from neuraminidase__InfluenzaA__AAY18129
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggcugaguaccggaauuggagcaagccccagugcaacaucacaggguucgccccuuuuuccaaagacaauucuauucgccuuagcgcgggaggcgauaucugggucaccagagagcccuauguguccugugacccugauaagugcuaccaauucgcucuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggccuggcuucauguguguguuaccggcgaugacaaaaacgcuaccgccuccuucauuuacaaugggcggcugguggauagcaucggaucuugguccaagaaaauucuccgcacacaggagagcgaaugcgucuguaucaacggcacgugcaccguggugaugacagacgggucugcuuccggaaaggccgauaccaaaauucuguuuaucgaggagggcaagaucauucacaucagcacacuuuccgggucugcgcaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacgccccggaagaaugauucuagcuccucuagccauugucucgacccgaacaaugaagagggaggccacggggucaaaggaugggccuucgaugacggcaacgauguguggauggggcgcaccaucuccgaaaagcugagaagcggauacgagacauuuaaaguuaucgagggcuggucuaaguccaauagcaaacugcagauuaaccgccaggugaucgucgaacggggcaauagaucuggguauuccggaauuuucagcguggagggcaaguccugcaucaaccgguguuuuuacgucgaacucauuagagggcgcaaggaggaaaccgaggugugguggaccucuaauagcaucguuguguucugcggaacauccggcaccuaugggacaggcucuuggccugacggagcugauauuaaccugaugcccaucuga

SEQ ID NO: 197241 - RNA, 1410 nt, Artificial Sequence
  derived and/or modified sequence opt5 from neuraminidase__InfluenzaA__AAY18139
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagcgggaaauuuguccuaagcuggccgaguaucgcaauuggagcaaaccccagugcaacaucaccggguucgcgccuuuuuccaaggacaauucuauuagacuuagcgcuggaggcgauaucugggucacacgggagcccuacguguccugugacccugauaaaugcuaucaauucgcccuggggcagggaaccacacucaacaaucgccacucuaacgacaccguucaugauagaacgccguaccggacacugcugaugaaugaacucggcgugcccuuucaccuggggacccgccaggucuguaucgccuggagcuccagcucuugccaugacggaaaggcuuggcuucacguguguguuacaggcgaugacaagaacgccaccgcuuccuucauuuauaauggcagacugguggauagcaucgggucuugguccaaaaagauucuccggacccaggagagcgaaugcgucuguaucaacggaacaugcacgguggugaugaccgacggcucugccuccgggaaagcggauacaaagauucuguuuaucgaggagggaaaaaucguccacauuagcacccuuuccggcucugcccaacauguugaagagugcagcuguuacccucgcuaucccggggugagaugcgugugucgggacaacuggaagggauccaaucgcccuaucgucgauauuaacgugaaggacuacagcaucguuucuuccuacgugugcagcggccuggucggcgacacaccccggaaaaaugauucuagcuccucuagccacugucucgacccgaacaaugaagaagggggacauggcgugaaggggugggcuuucgaugacggaaacgauguuuggaugggcagaaccauuuccgagaaacugcgcagcggguaugagacguuuaaggugaucgagggauggucuaaaccuaauuccaagcugcagaucaacagacaggucauuguggaacggggcaauagaagcggcuacucugggaucuucuccgucgagggaaaaagcugcauuaaccgcuguuuuuauguggaacucauccggggcagaaaggaggaaacagagguuugguggaccuccaauucuauuguggucuucugcgggaccagcggaacauacggcaccggguccuggcccgacggcgccgauaucaaccugaugccuauuuga

SEQ ID NO: 197242 - RNA, 1410 nt, Artificial Sequence
  derived and/or modified sequence opt5 from neuraminidase__InfluenzaA__AAY18149
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuacagucgauaucaacgugaaagacuacagcauuguuucuuccuacgugugcagcggccuggucggggacacgccccggaagaaugauucuagcuccucuagccacugucucgacccgaacaaugaagagggaggccauggggugaaaggaugggcuuucgaugacggcaacgauguuuggauggggcgcaccaucuccgaaaagcugagaagcggauaugagacauuuaaagugauugagggcuggucuaagccuaauuccaaacugcagaucaaccggcaggucaucguggaacgcggcaauagaagcggguacucuggaauuuucuccgucgagggcaagagcugcaucaaccgguguuuuuauguggaacucauuagagggcgcaaggaggaaaccgagguuugguggaccuccaauucuaucguggucuucugcggaacaagcggcaccuacgggacaggcuccuggcccgacggagccgauauuaaccugaugccuaucuga

SEQ ID NO: 197243 - RNA, 1410 nt, Artificial Sequence
  derived and/or modified sequence opt5 from neuraminidase__InfluenzaA__AAY18159
augaaccccaaucagaagaucauuaccaucggcagcgugucccugauuaucgccacaauuugcuuccucaugcaaaucgcuauccuggucacgaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaacauuacgggguucgcgccuuuuuccaaagacaauucuauccgccuuagcgcuggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaaagcaggucuguauugccuggagcuccagcucuugccacgacggcaaagccuggcuucauguguguguuaccggcgaugacgagaacgcuacagcuuccuucaucuacaaugggagacugguggauagcauuggaucuugguccaagaaaauccuccggacccaggaaagcgagugcgucuguauuaacgggaccugcacaguggugaugacggacggcucugccuccggaaaggcggauaccaaaauccuguuuaucgaggaaggcaagauuguccacacaagcucccuuucugggagcgcccaacacguugaggaaugcuccuguuauccucgcuaccccggagugagaugcgugugucgggacaacuggaagggcagcaaucgcccuaucgucgauauuaacgugaaagacuacucuaucguuuccagcuaugugugcucuggccuggucggggacacccccagaaagaaugauagcuccucuagcucccauugucucgacccgaacaaugaggaaggaggccacggggugaaaggaugggcuuucgaugacggcaacgauguuuggauggggcggacaauuagcgagaagcugcgcucuggauacgagaccuuuaaagugaucgaaggcugguccaagccuaauagcaaacugcagaucaacagacaggucauuguggaccggggcaaucgcucuggguauuccggaaucuucagcgucgagggcaagaacugcauuaauagauguuuuuacguggaacucauccgggggagaaagcaggagacggaaguucuguggacauccaacucuauuguggucuucugcggaaccagcggcaccuaugggacaggcuccuggcccgauggagccgacaucaaucuuaugccuauuuga

SEQ ID NO: 197244 - RNA, 1410 nt, Artificial Sequence; identical to SEQ ID NO: 197085
  derived and/or modified sequence opt5 from neuraminidase__InfluenzaA__AAY18179

SEQ ID NO: 197245 - RNA, 1410 nt, Artificial Sequence; identical to SEQ ID NO: 197085
  derived and/or modified sequence opt5 from neuraminidase__InfluenzaA__AAY18189

SEQ ID NO: 197246 - RNA, 1410 nt, Artificial Sequence
  derived and/or modified sequence opt5 from neuraminidase__InfluenzaA__AAY18199
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcagggagugaaaggcugggccuucgaugacgggaacgauguuuggaugggacggacgaucagcgagaagcuccacucuggcuacgagacauuuaaagugaucgaagggugguccaauccuaacagcaagcugcagauuaaucgccaggucaucguggacagaggaaaccggucuggcuauuccggcauuuucagcgucgaggggaaauccuguaucaaucgcugcuuuuacguggaacugauuagaggacggaagcaagagaccgaaguucucuggaccucuaacagcaucguggucuucuguggcacauccgggaccuauggaacaggcucuuggcccgauggggcugacauuaaucugaugccuaucuga

SEQ ID NO: 197247 - RNA, 1410 nt, Artificial Sequence; identical to SEQ ID NO: 197188
  derived and/or modified sequence opt5 from neuraminidase__InfluenzaA__AAY18588

SEQ ID NO: 197248 - RNA, 1410 nt, Artificial Sequence; identical to SEQ ID NO: 197169
  derived and/or modified sequence opt5 from neuraminidase__InfluenzaA__AAY18614

SEQ ID NO: 197249 - RNA, 1410 nt, Artificial Sequence
  derived and/or modified sequence opt5 from neuraminidase__InfluenzaA__AAY27846
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacggagguuugguggacaagcaauuccauuguggucuuuugcggaaccucuggcaccuacgggacaggcagcuggcccgacggagcugauaucaaccugaugccuauuuga

SEQ ID NO: 197250 - RNA, 1410 nt, Artificial Sequence
  derived and/or modified sequence opt5 from neuraminidase__InfluenzaA__AAY27856
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugggaagugcuaucaauucgcccugggacagggcaccacacucaacaaugggcacucuaacgauaccguucaugaccggacgccguaccgcacacugcugaugaaugaacucggagugcccuuucaccugggcaccagacaggucuguaucgccuggagcuccagcucuugccaugauggcaaggcuuggcuucacguguguguuacaggggacgauaaaaacgccaccgcuuccuucauuuauaauggacggcugguggacagcaucggcucuugguccaagaaaauucuccgcacccaggagagcgaaugcgucuguaucaacgggacaugcacgguggugaugaccgauggaucugccuccggcaaggcggacacaaaaauucuguuuaucgaggaggggaagaucguccacauuagcacccuuuccggaucugcccaacauguugaagagugcagcuguuacccuagauaucccggcgugcggugcgugugucgcgauaacuggaagggcuccaauagaccuaucgucgacauuaacgugaaagauuacagcaucguuucuuccuacgugugcagcgggcuggucggagacacaccccggaagaaugacucuagcuccucuagccacugucucgauccgaacaaugaagagggcgggcauggagugaaaggcugggcuuucgacgaugggaacgacguuuggaugggacgcaccauuuccgaaaagcugagaagcggcuaugagacguuuaaagugaucgagggcuggucuaagccuaauuccaaacugcagaucaaccggcaggucauuguggaacgcgggaauagaagcggauacucuggcaucuucuccgucgagggaaagagcugcauuaaccgguguuuuuauguggaacucaucagagggcgcaaggaggaaacagagguuugguggaccuccaauucuauuguggucuucugcggcaccagcgggacauacggcaccggauccuggcccgauggcgccgacaucaaccugaugccuauuuga

SEQ ID NO: 197251 - RNA, 1410 nt, Artificial Sequence; identical to SEQ ID NO: 197161
  derived and/or modified sequence opt5 from neuraminidase__InfluenzaA__AAY27866

SEQ ID NO: 197252 - RNA, 1410 nt, Artificial Sequence
  derived and/or modified sequence opt5 from neuraminidase__InfluenzaA__AAY27962
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacaauguuuggauggggcgcaccauuagcgagaaacugagauccggauacgagacguucaaggugaucgaaggcuggagcaaaccuaacucuaagcugcagacaaaucggcaggucaucguggagcgcggcaacagauccggguauagcggaaucuuuucugucgaaggcaaauccugcauuaaucgguguuucuacguggagcucauuagagggcgcaaggaagagaccgagguuugguggaccagcaacuccaucguggucuuuugcggaacaucuggcaccuaugggacaggcagcuggcccgauggagccgacauuaaucugaugccuaucuga

SEQ ID NO: 197253 - RNA, 1410 nt, Artificial Sequence
  derived and/or modified sequence opt5 from neuraminidase__InfluenzaA__AAY27997
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacaauaccguucaugaccggacgccguaccgcacacugcugaugaacgaaaugggggugcccuuucaccucggaaccagacaggucuguaucgccuggagcuccagcucuugccaugauggcaaggcuuggcugcacguguguguuacaggcgacgauaaaaaugccaccgcuuccuucauuuauaacgggcggcuuguggacagcaucggaucuugguccaagaaaauucugcgcacccaggagagcgaaugcgucuguaucaacggcacaugcacgguggugaugaccgaugggucugccuccggaaaggcggacacaaaaauucucuuuaucgaggagggcaagaucguccacauuagcacccuguccgggucugcccaacauguugaagagugcagcuguuacccuagauaucccggagugcggugcgugugucgcgauaauuggaagggcuccaacagaccuaucgucgacauuaaugugaaagauuacagcaucguuucuuccuacgugugcagcggccuugucggggacacaccccggaagaacgacucuuucagcuccucucacugucuggauccgaauaacgaagagggaggccauggggugaaaggaugggcuuuugacgauggcaaugacguuuggauggggcgcaccauuagcgaaaagcucagauccggauaugagacguucaaagugaucgagggcuggagcaagccuaacucuaaacugcagaucaaucggcaggucauuguggaacgcggcaacagauccggguacagcggaaucuuuucugucgagggcaaguccugcauuaaucgguguuucuauguggaacugaucagagggcgcaaggaggaaacagagguuugguggaccagcaacuccauuguggucuuuugcggaaccucuggcacauacgggaccggcagcuggcccgauggagccgacaucaaucucaugccuauuuga

SEQ ID NO: 197254 - RNA, 1410 nt, Artificial Sequence; identical to SEQ ID NO: 197159
  derived and/or modified sequence opt5 from neuraminidase__InfluenzaA__AAY28007

SEQ ID NO: 197255 - RNA, 1410 nt, Artificial Sequence; identical to SEQ ID NO: 197204
  derived and/or modified sequence opt5 from neuraminidase__InfluenzaA__AAY28017

SEQ ID NO: 197256 - RNA, 1410 nt, Artificial Sequence; identical to SEQ ID NO: 197159
  derived and/or modified sequence opt5 from neuraminidase__InfluenzaA__AAY28268

SEQ ID NO: 197257 - RNA, 1410 nt, Artificial Sequence
  derived and/or modified sequence opt5 from neuraminidase__InfluenzaA__AAY28278
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacaccagcaaacuuuccggcucugcccaacauguugaggaaugcagcuguuauccucgguaccccggggugcgcugcguguguagagacaauuggaagggauccaaccggccuauugucgauaucaacgugaaggacuacagcauuguuucuuccuaugugugcagcggccuggucggcgacacaccccgcaaaaaugauucuagcuccucuagccacugucucgacccgaacaaugaggaagggggacauggcgugaaggggugggcuuucgaugacggaaacgauguuuggaugggcagaaccaucuccgagaaaagccggucuggguacgagacguuuaaggugauugaaggaugguccaaaccuaauagcaagcugcagaucaaccgccaggucaucguggagagaggcaaucggucuggcuauuccgggauuuucagcgucgaaggaaaguccugcaucaacagauguuuuuacguggagcugauucgcggccggaaacccgaaacagagguuugguggaccucuaauagcaucguggucuucugcgggaccuccggaacauauggcaccgggucuuggccugacggcgccgauauuaaccucaugcccaucuga

SEQ ID NO: 197258 - RNA, 1410 nt, Artificial Sequence; identical to SEQ ID NO: 197173
  derived and/or modified sequence opt5 from neuraminidase__InfluenzaA__AAY28288

SEQ ID NO: 197259 - RNA, 1410 nt, Artificial Sequence
  derived and/or modified sequence opt5 from neuraminidase__InfluenzaA__AAY28298
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuagcuccucuagccacugucucgacccgaacaaugaagagggaggccauggggugaaaggaugggcuuucgaugacggcaacgauguuuggauggggcgcaccauuuccgaaaagcugagaagcggauaugagacguuuaaagugaucgagggcuggucucggccuaauuccaagcugcagaucaaccgccaggucauuguggaaagaggcaaucggagcggguacucuggaaucuucuccgucgagggcaaaagcugcauuaacagauguuuuuauguggaacucauccgcgggcggaaggaggaaacagagguuugguggaccuccaauucuauuguggucuucugcggaaccagcggcacauacgggaccggcuccuggcccgacggagccgauaucaaccugaugccuauuuga

SEQ ID NO: 197260 - RNA, 1410 nt, Artificial Sequence; identical to SEQ ID NO: 197190
  derived and/or modified sequence opt5 from neuraminidase__InfluenzaA__AAY28308

SEQ ID NO: 197261 - RNA, 1410 nt, Artificial Sequence
  derived and/or modified sequence opt5 from neuraminidase__InfluenzaA__AAY28318
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcgccguggugaugacggacgggucugcguccggaaaagccgauaccaagauucuguuuaucgaggaaggcaaaaucguccacauuagcacacuuuccgggucugcucaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggccuuugaugacggcaacgauguuuggauggggcgcaccauuagcgagaaacugagauccggauacgagaccuucaaggugaucgaaggcuggagcaaaccuaauucuaagcugcagacgaaccggcaggucaucguggagcgcggcaauagauccggguauagcggaaucuuuucugucgaaggcaaauccugcauuaaccgguguuucuacguggagcucauuagagggcgcaaggaagagacagagguuugguggaccagcaauuccaucguggucuuuugcggaaccucuggcacauaugggaccggcagcuggcccgacggagcugauauuaaccugaugccuaucuga

SEQ ID NO: 197262 - RNA, 1410 nt, Artificial Sequence
  derived and/or modified sequence opt5 from neuraminidase__InfluenzaA__AAY28338
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauucggccuaaacuggcggaguaccgcaauuggagcaagccccaguguaacaucacgggguucgcuccuuuuuccaaagacaauucuauuagacuuagcgccggaggcgauaucugggucacccgggagcccuauguguccugcgacccugauaaguguuaccaauucgcccuggggcagggaacaacccucaacaauggccauucuaacgacacaguucacgaucgcaccccguauagaacgcugcugaugaaugaacucggggugcccuuucaucugggaacacggcaggucugcaucgcuuggagcuccagcucuugucacgacggcaaggccuggcuucaugugugcguuaccggcgaugacgagaacgcuacagccuccuucauuuacaaugggcgccugguggauagcaucggaucuugguccaaaaagauucucagaacccaggaaagcgagugugucugcaucaacggcaccuguacaguggugaugacggacgggucugcguccggaaaagccgauaccaagauucuguuuaucgaggaaggcaaaaucgucaacauuagcacacuuuccgggucugcucaacacguugaggaaugcagcugcuauccucgguaccccggagugcgcugugugugcagagacaauuggaagggcuccaaccggccuaucgucgauauuaaugugaaggacuacagcaucguuucuuccuauguguguagcggccuggucggggacacaccccgcaaaaacgauucuuucagcuccucucacugccucgacccgaauaacgaggaaggaggccauggggugaagggaugggccuuugaugacggcaaugauguuuggauggggagaaccauuagcgagaaacugcgguccggauacgagaccuucaaggugaucgaaggcuggagcaaaccuaacucuaagcugcagaucaaucgccaggucauuguggagagaggcaaccgguccggguauagcggaaucuuuucugucgaaggcaaauccuguauuaauagaugcuucuacguggagcucauccgcgggcggaaggaagagacggagguuugguggacaagcaacuccauuguggucuuuuguggaaccucuggcaccuaugggacaggcagcuggcccgacggagcugauaucaaucugaugccuauuuga

SEQ ID NO: 197263 - RNA, 1410 nt, Artificial Sequence; identical to SEQ ID NO: 197169
  derived and/or modified sequence opt5 from neuraminidase__InfluenzaA__AAY28348

SEQ ID NO: 197264 - RNA, 1410 nt, Artificial Sequence; identical to SEQ ID NO: 197085
  derived and/or modified sequence opt5 from neuraminidase__InfluenzaA__AAY28358

SEQ ID NO: 197265 - RNA, 1410 nt, Artificial Sequence; identical to SEQ ID NO: 197169
  derived and/or modified sequence opt5 from neuraminidase__InfluenzaA__AAY28388

SEQ ID NO: 197266 - RNA, 1410 nt, Artificial Sequence; identical to SEQ ID NO: 197174
  derived and/or modified sequence opt5 from neuraminidase__InfluenzaA__AAY28398

SEQ ID NO: 197267 - RNA, 1410 nt, Artificial Sequence; identical to SEQ ID NO: 197188
  derived and/or modified sequence opt5 from neuraminidase__InfluenzaA__AAY28408

SEQ ID NO: 197268 - RNA, 1410 nt, Artificial Sequence; identical to SEQ ID NO: 197161
  derived and/or modified sequence opt5 from neuraminidase__InfluenzaA__AAY28505

SEQ ID NO: 197269 - RNA, 1410 nt, Artificial Sequence
  derived and/or modified sequence opt5 from neuraminidase__InfluenzaA__AAY28524
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacuacaccguucaugaccggacgccguaucgcacacugcugaugaaugaacucggggugcccuuucaccugggaaccagacaggucuguaucgccuggagcuccagcucuugccaugauggcaaggcuuggcuucacguguguguuacaggcgacgauaaaaacgccaccgcuuccuucauuuacaaugggcggcugguggacagcaucggaucuugguccaagaaaauucuccgcacccaggagagcgaaugcgucuguaucaacggcacaugcacgguggugaugaccgaugggucugccuccggaaaggcggacacaaaaauucuguuuaucgaggagggcaagaucguccacauuagcacccuuuccgggucugcccaacauguugaagagugcagcuguuauccuagauaccccggagugcggugcgugugucgcgauaacuggaagggcuccaauagaccuaucgucgacauuaacgugaaagauuacagcaucguuucuuccuaugugugcagcggccuggucggggacacaccccggaagaaugacucuagcuccucuagccacugucucgauccgaacaaugaagagggaggccauggggugaaaggaugggcuuucgacgauggcaacgacguuuggauggggcgcaccauuuccgaaaagcugagaagcggauacgagacguuuaaagugaucgagggcuggucuaagccuaauuccaaacugcagaucaaccggcaggucauuguggaacgcggcaauagaagcggguauucuggaaucuucuccgucgagggcaagagcugcauuaaccgguguuuuuacguggaacucaucagagggcgcaaggaggaaacagagguuugguggaccuccaauucuauuguggucuucugcggaaccagcggcacauaugggaccggcuccuggcccgauggagccgacaucaaccugaugccuauuuga

SEQ ID NO: 197270 - RNA, 1410 nt, Artificial Sequence; identical to SEQ ID NO: 197159
  derived and/or modified sequence opt5 from neuraminidase__InfluenzaA__AAY28534

SEQ ID NO: 197271 - RNA, 1410 nt, Artificial Sequence
  derived and/or modified sequence opt5 from neuraminidase__InfluenzaA__AAY28544
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccuaacaagugcuaucaauucgcccuggggcagggaaccacacucaauaacggccacucuaaugauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucauuuauaacgggcggcugguggacagcaucggaucuugguccaagaaaauucuccgcacccaggagagcgaaugcgucuguaucaacggcacaugcacgguggugaugaccgaugggucugccuccggaaaggcggacacaaaaauucuguuuaucgaggagggcaagaucguccacauuagcacccuuuccgggucugcccaacauguugaagagugcagcuguuacccuagauaucccggagugcggugcgugugucgcgauaauuggaagggcuccaacagaccuaucgucgacauuaaugugaaagauuacagcaucguuucuuccuacgugugcagcggccuggucggggacacaccccggaagaacgacucuuucagcuccucucacugucucgauccgaauaacgaagagggaggccauggggugaaaggaugggcuuuugacgauggcaaugacguuuggauggggcgcaccauuagcgaaaagcugagauccggauaugagacguucaaagugaucgagggcuggagcaagccuaacucuaaacugcagaucaaucggcaggucauuguggaacgcggcaacagauccggguacagcggaaucuuuucugucgagggcaaguccugcauuaaucgguguuucuauguggaacucaucagagggcgcaaggaggaaacagagguuugguggaccagcaacuccauuguggucuuuugcggaaccucuggcacauacgggaccggcagcuggcccgauggagccgacaucaaucugaugccuauuuga

SEQ ID NO: 197272 - RNA, 1410 nt, Artificial Sequence; identical to SEQ ID NO: 197085
  derived and/or modified sequence opt5 from neuraminidase__InfluenzaA__AAY28554

SEQ ID NO: 197273 - RNA, 1410 nt, Artificial Sequence
  derived and/or modified sequence opt5 from neuraminidase__InfluenzaA__AAY28564
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuagcuccucuagccacugucucgacccgaacaaugaagagggaggccauggggugaaaggaugggcuuucgaugacggcaacgauguuuggauggggcgcaccauuuccgaaaagcugagaagcggauaugagacguuuaaagugaucgagggcuggucucggccuaauuccaagcugcagaucaaccgccaggucauuguggaaagaggcaaucggagcggguacucuggaaucuucuccgucgagagcaaauccugcauuaacagauguuuuuauguggaacucauccgcggccggaaggaggaaacagagguuugguggaccucuaauagcauuguggucuucugcgggaccuccggaacauacggcaccgggucuuggcccgacggcgccgauaucaaccugaugccuauuuga

SEQ ID NO: 197274 - RNA, 1410 nt, Artificial Sequence; identical to SEQ ID NO: 197159
  derived and/or modified sequence opt5 from neuraminidase__InfluenzaA__AAY28574

SEQ ID NO: 197275 - RNA, 1410 nt, Artificial Sequence; identical to SEQ ID NO: 197173
  derived and/or modified sequence opt5 from neuraminidase__InfluenzaA__AAY28584

SEQ ID NO: 197276 - RNA, 1410 nt, Artificial Sequence; identical to SEQ ID NO: 197085
  derived and/or modified sequence opt5 from neuraminidase__InfluenzaA__AAY28594

SEQ ID NO: 197277 - RNA, 1410 nt, Artificial Sequence
  derived and/or modified sequence opt5 from neuraminidase__InfluenzaA__AAY28611
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgagggcaaguccugcaucaacagauguuuuuacguggaacucauucgggggagaaagcaggagacagaaguucuguggaccucuaauagcaucguggucuucugcggaaccuccggcacauaugggaccggcucuuggcccgauggagccgacauuaaccuuaugccuaucuga

SEQ ID NO: 197278 - RNA, 1410 nt, Artificial Sequence; identical to SEQ ID NO: 197190
  derived and/or modified sequence opt5 from neuraminidase__InfluenzaA__AAY28651

SEQ ID NO: 197279 - RNA, 1410 nt, Artificial Sequence
  derived and/or modified sequence opt5 from neuraminidase__InfluenzaA__AAY44613
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaaaucgccgaguaucggaauuggagcaagccccagugcaacauuaccggguucgcgccuuuuuccaaagacaauucuauccgccugagcgcuggaggcgauaucugggucacaagagagcccuacguguccugugacccugauaagugcuaucaauucgcccuugggcagggaaccacacugaacaauggccacucuaacgacaccguucaugaucggacgccguaccgcacacuccugaugaaugaacugggggugcccuuucaccucggaaccagacaggucuguauugccuggagcuccagcucuugccaugacggcaaggcuuggcugcacguguguguuacaggcgaugacaaaaacgccaccgcuuccuucaucuauaaugggcggcuuguggauagcauuggaucuugguccaagaaaauccugcgcacccaggagagcgaaugcgucuguauuaacggcacaugcacgguggugaugaccgacgggucugccuccggaaaggcggauacaaaaauccucuuuaucgaggagggcaagauuguccacaucagcacccuguccgggucugcccaacauguugaagagugcagcuguuacccuagauaucccggagugcggugcgugugucgcgacaacuggaagggcuccaauagaccuauugucgauaucaacgugaaagacuacagcauuguuucuuccuacgugugcagcggccuugucggggacacaccccggaagaaugauucuagcuccucuagccacugucuggacccgaacaaugaagagggaggccauggggugaaaggaugggcuuucgaugacggcaacgauguuuggauggggcgcaccaucuccgaaaagcucagaagcggauaugagacguuuaaagugaucgagggcuggucuaagccuaauuccaaacugcagauuaaccggcaggucaucguggaacgcggcaauagaagcggguacucuggaauuuucuccgucgagggcaagagcugcaucaaccgguguuuuuauguggaacugauuagagggcgcaaggaggaaacagagguuugguggaccuccaauucuaucguggucuucugcggaaccagcggcacauacgggaccggcuccuggcccgacggagccgauauuaaccucaugccuaucuga

SEQ ID NO: 197280 - RNA, 1410 nt, Artificial Sequence; identical to SEQ ID NO: 197173
  derived and/or modified sequence opt5 from neuraminidase__InfluenzaA__AAY44624

SEQ ID NO: 197281 - RNA, 1410 nt, Artificial Sequence; identical to SEQ ID NO: 197195
  derived and/or modified sequence opt5 from neuraminidase__InfluenzaA__AAY44634

SEQ ID NO: 197282 - RNA, 1410 nt, Artificial Sequence; identical to SEQ ID NO: 197188
  derived and/or modified sequence opt5 from neuraminidase__InfluenzaA__AAY44644

SEQ ID NO: 197283 - RNA, 1410 nt, Artificial Sequence
  derived and/or modified sequence opt5 from neuraminidase__InfluenzaA__AAY44654
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagauccauagacaggucaucguggaccggggcaaccgcucuggguauuccggaauuuucagcgucgagggcaaguccugcaucaauagauguuuuuacguggaacucauucgggggagaaagcaggagacagaaguucuguggaccucuaacagcaucguggucuucugcggaaccuccggcacauaugggaccggcucuuggcccgauggagccgacauuaaucuuaugccuaucuga

SEQ ID NO: 197284 - RNA, 1410 nt, Artificial Sequence
  derived and/or modified sequence opt5 from neuraminidase__InfluenzaA__AAY44758
augaaccccaaucagaagaucauuaccaucggcagcgugucccugacaauugccacgaucugcuuccucaugcaaauugcuauccuggucaccacaguuacccuucacuuuaaacaguacgaguguaacucuccuagcaauaaccaggugaugcugugcgaaccgacaaucauugagagaaauaucaccgaaauuguguaucucacaaacaccacgaucgagaaggaaauuugucccaaacuggccgaguaccggaauugguccaagccucagugcaaaaucaccggguucgcgcccuuuucuaaggacaacagcauucgccuuuccgcuggaggcgauaucugggucacaagagagccuuaugugucuugugaccccgauaagugcuaccaauucgcccuggggcagggaaccacacucaauaaccggcauagcaaugacaccguucacgaucgcacgccuuauagaacacugcugaugaacgaacucggcgugccguuucaucuggggaccaaacaggucuguaucgccugguccucuucuuccugccacgacggaaaggcuuggcuucauguguguguuacaggccacgaugagaaugccaccgcuagcuucauuuacgacggccggcugguggauucuaucggguccuggagcaaaaagauucuccgcacccaggaaucugagugcgucuguaucaacggaacaugcacgguggugaugaccgacggcuccgccagcgggagagcggauacaaaaauucuguuuaucgaggaaggaaagaucguccacaccuccaaacuuucuggcagcgcccaacauguugaggaaugcuccuguuauccccgguacccuggggugcgcugcguguguagagacaauuggaagggaagcaaccggcccauugucgauaucaacgugaaggacuacucuauuguuuccagcuaugugugcucuggccuggucggcgacacaccucgcaaaaaugauagcuccucuagcucccacugucucgaccccaacaaugaggaagggggacauggcgugaaggggugggcuuucgaugacggaaacgauguuuggaugggcagaaccaucagcgagaaaucucgguccggguacgagacguuuaaggugauugaaggauggagcaaaccgaauagcaagcugcagaucaaccgccaggucaucguggagagaggcaaucgguccggcuauagcgggauuuucuccgucgaaggaaagucuugcaucaacagauguuuuuacguggagcugauucgcggccggaaaccugaaacagagguuugguggaccagcaauuccaucguggucuucugcgggaccucuggaacauauggcaccgggagcuggcccgacggcgccgauauuaaccucaugccuaucuga

SEQ ID NO: 197285 - RNA, 1410 nt, Artificial Sequence; identical to SEQ ID NO: 197085
  derived and/or modified sequence opt5 from neuraminidase__InfluenzaA__AAY44778

SEQ ID NO: 197286 - RNA, 1410 nt, Artificial Sequence
  derived and/or modified sequence opt5 from neuraminidase__InfluenzaA__AAY44788
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagauuuuuaaagugaucgaaggcuggucuaagccuaauuccaaacuccagaucaacagacaggucauuguggaccggggcaaucgcagcggguauucuggaaucuucuccgucgagggcaagagcugcauuaacagauguuuuuacguggaacugauccgggggagaaagcaggagacggaaguucuuuggacauccaauucuauuguggucuucugcggaaccagcggcaccuaugggacaggcuccuggcccgauggagccgacaucaaccugaugccuauuuga

SEQ ID NO: 197287 - RNA, 1410 nt, Artificial Sequence; identical to SEQ ID NO: 197161
  derived and/or modified sequence opt5 from neuraminidase__InfluenzaA__AAY44909

SEQ ID NO: 197288 - RNA, 1410 nt, Artificial Sequence; identical to SEQ ID NO: 197188
  derived and/or modified sequence opt5 from neuraminidase__InfluenzaA__AAY45649

SEQ ID NO: 197289 - RNA, 1410 nt, Artificial Sequence
  derived and/or modified sequence opt5 from neuraminidase__InfluenzaA__AAY46374
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccuuacaagugcuaucaauucgcccuggggcagggaaccacacucaauaaccggcauucuaaugauaccguucacgaccgcacgccguacagaacacugcugaugaacgaacucggcgugcccuuucaucuggggaccaaacaggucuguaucgccuggagcuccagcucuugccacgauggaaaggcuuggcuucauguguguguuacaggccacgacgagaaugccaccgcuuccuucauuuaugauggccggcugguggacagcaucgggucuugguccaaaaagauucuccgcacccaggaaagcgagugcgucuguaucaacggaacaugcacgguggugaugaccgauggcucugccuccgggagagcggacacaaaaauucuguuuaucgaggaaggaaagaucguccacaccagcaaacuuuccggcucugcccaacauguugaggaaugcagcuguuacccucgguaccccggggugcgcugcguguguagagauaauuggaagggauccaaccggccuauugucgacaucaacgugaaggauuauagcauuguuucuuccuacgugugcagcggccuggucggcgacacaccccgcaaaaaugacucuagcuccucuagccacugucucgauccgaacaaugaggaagggggacauggcgugaaggggugggcuuucgacgauggaaacgacguuuggaugggcagaaccaucuccgagaaaagccggucuggguaugagacguuuaaggugauugaaggaugguccaaaccuaauagcaagcugcagaucaaccgccaggucaucguggagagaggcaauaugucuggcuacuccgggauuuucagcgucgaaggaaaguccugcaucaaccgguguuuuuauguggagcugauuagaggccgcaaacaggaaacagagguuugguggaccucuaauagcaucguggucuucugcgggaccuccggaacauacggcaccgggucuuggcccgauggcgccgacauuaaccucaugccuaucuga

SEQ ID NO: 197290 - RNA, 1410 nt, Artificial Sequence
  derived and/or modified sequence opt5 from neuraminidase__InfluenzaA__AAY46384
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacgccguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacggagguuugguggacaagcaauuccauuguggucuuuugcggaaccucuggcaccuacgggacaggcagcuggcccgacggagcugauaucaaccugaugccuauuuga

SEQ ID NO: 197291 - RNA, 1410 nt, Artificial Sequence
  derived and/or modified sequence opt5 from neuraminidase__InfluenzaA__AAY46394
augaaccccaaucagaagaucauuaccaucggcagcgugucccugacaauugccacgaucugcuuccucaugcaaauugcuauccugaucaccacagucacccuucacuuuaaacaguacgaguguaacucuccuccgaauaaccagguuaugcugugcgaacccacaauuaucgagagaaauauuaccgaaaucguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauaucugggugacaagagagcccuaugucuccugugacccugauaagugcuaccaauucgcccuggggcagggaaccacacucaacaauggccauucuaacgacaccgugcacgaucggacgccguaucgcacacugcugaugaaugaacucgggguucccuuucaucugggaaccaaacagguguguauugccuggagcuccagcucuugccacgacggcaaggcuuggcuucaugucugugugacaggcgaugacgagaacgccaccgcuuccuucaucuacaaugggagacugguugauagcauuggaucuugguccaagaaaauccuccggacccaggaaagcgagugcguguguauuaacggcacaugcacggucgugaugaccgacgggucugccuccggaaaggcggauacaaaaauccuguuuaucgaggaaggcaagauugugcacaccagcucccuuucugggagcgcccaacacgucgaggaaugcuccuguuauccucgcuaccccggaguuagaugcgugugucgggacaacuggaagggcagcaaucgcccuaucguggauauuaacgucaaagacuacucuaucguguccagcuauguuugcucuggccuggugggggacacacccagaaagaaugauagcuccucuagcucccauugucucgacccgaacaaugaggaaggaggccacggggucaaaggaugggcuuucgaugacggcaacgauguguggauggggcggaccauuagcgagaagcugcgcucuggauacgagacguuuaaaguuaucgaaggcugguccaagccuaauagcaaacugcagaucaacagacaggugauugucgaccggggcaaucgcucuggguauuccggaaucuucagcguggagggcaaguccugcauuaacagauguuuuuacgucgaacucauccgggggagaaagcaggagacagaagugcuguggaccucuaauagcauuguuguguucugcggaaccuccggcacauaugggaccggcucuuggcccgauggagccgacaucgaucuuaugccuauuuga

SEQ ID NO: 197292 - RNA, 1410 nt, Artificial Sequence
  derived and/or modified sequence opt5 from neuraminidase__InfluenzaA__AAY46419
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacaaugagaacgccaccgcuuccuucaucuacggcgggcggcugguggauagcauuggaucuugguccaaaaagauccuucgcacccaggaaagcgagugcgucuguauuaauggcacaugcacgguggugaugaccgacgggucugccuccggcagagcggauacaaaaauccuguuuauugaggaaggaaagaucauccacauuagccaacucuccgggucugcccagcaugucgaggaaugcagcuguuauccccgguacccuggaguucgcugcguguguagagacaacuggaagggcuccaaccggcccaucguggauauuaaugucaaagacuacagcaucgugucuuccuauguuugcagcggccuggugggggauaccccucgcaagaacgacucuagcuccucuagccacugucugaaucccaacaaugaggaaggaggccauggggucaaaggaugggcuuucgacgauggcaacgacguguggauggggagaacaauuuccgagaaguuucggagcggauacgagaccuucaaaguuaucgaaggcuggucuaagccuaauuccaaacuccagaucaaccgccaggugauugucgauagagacaaucggagcggcuauucugggaucuuuuccguggagggaaagagcugcauuaacagauguuucuacgucgaacugauccgcggccggaagcaagagacggaagugugguggacauccaauucuauuguuguguuuugcgggaccagcggaaccuauggcacaggguccuggccggauggcgccgacaucaaccuuaugcccauuuga

SEQ ID NO: 197293 - RNA, 1410 nt, Artificial Sequence
  derived and/or modified sequence opt5 from neuraminidase__InfluenzaA__AAY47016
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggaacgcccaacacguugaggaaugcucuuguuauccuagauaccccggagugcggugcgugugucgcgacaauuggaagggcagcaacagaccuaucgucgauauuaaugugaaggacuacuccaucguuagcucuuaugugugcuccggccuggucggggacacaccccggaaaaacgauagcuucucuagcucccauugucucgacccgaacucugaggaaggaggccacggggugaagggaugggcuuuugaugacggcaaugauguuuggauggggcgcaccauuagcgagaaacugagauccggauacgagacguucaaggugaucgaaggcuggagcaaaccuaauucuaagcugcagaucaaccggcaggucauuguggagcgcggcaauagauccggguauagcggaaucuuuucugucgaaggcaaauccugcauuaaccgguguuucuacguggagcucaucagagggcgcaaggaagagacagagguuugguggaccagcaauuccauuguggucuuuugcggaaccucuggcacauaugggaccggcagcuggcccgacggagccgauaucaaccugaugccuauuuga

SEQ ID NO: 197294 - RNA, 1410 nt, Artificial Sequence
  derived and/or modified sequence opt5 from neuraminidase__InfluenzaA__AAY47055
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccggggcaaucgcagcggguauucuggaauuuucuccgucgagggcaagagcugcaucaacagauguuuuuacguggaacugauucgggggagaaagcaggagacagaaguucuuuggaccuccaauucuaucguggucuucugcggaaccagcggcacauaugggaccggcuccuggcccgauggagccgacauuaaccuguuuccuaucuga

SEQ ID NO: 197295 - RNA, 1410 nt, Artificial Sequence
  derived and/or modified sequence opt5 from neuraminidase__InfluenzaA__AAY47078
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugaccaugauaagugcuaccaauucgcccuggggcagggaaccacacucaacaauggccacucuaacgacaccguucaugaucggacgccuuaucgcacacugcugaugaaugaacucggggugccguuucaccugggaaccaagcaggucuguaucgccuggagcuccagcucuugccaugacggcaaagccuggcuucacguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacauguugaggaaugcagcuguuauccccgcuacccuggagugagaugcgugugucgggacaacuggaagggcuccaaucgccccaucgucgauauuaacgugaaagacuacagcaucguuucuuccuaugugugcagcggccuggucggggacacaccuagaaagaaugauucuuucagcuccucucacugucucgaccccaacaaugaggaaggaggccauggggugaaaggaugggcuuuugaugacggcaacgauguuuggauggggcggaccauuagcgagaagcugcgcuccggauacgagacguucaaagugaucgaaggcuggagcaagccuaauucuaaacugcagaucaacagacaggucauuguggagcggggcaaucgcuccggguauagcggaaucuuuucugucgaaggcaaguccugcauuaacagauguuucuacguggagcucauccgggggagaaaggaagagacagagguuugguggaccagcaauuccauuguggucuuuugcggaaccucuggcacauaugggaccggcagcuggccggacggagccgauaucaaccugaugcccauuuga

SEQ ID NO: 197296 - RNA, 1410 nt, Artificial Sequence
  derived and/or modified sequence opt5 from neuraminidase__InfluenzaA__AAY47088
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagaccauucuauuguuuccagcuacguguguucuggacuugucggcgacacccccagaaagaaugauagcuccucuagcucccacugccuggacccgaacaaugaggaaggcgggcauggagugaaaggcugggccuucgaugacgggaacgauguuuggaugggacggacgaucagcgagaagcuccgcucuggcuaugagacauuuaaagugaucgaagggugguccaauccuaacagcaagcugcagauuaauagacaggucaucguggaccggggaaaccgcucuggcuacuccggcauuuucagcgucgaggggaaauccuguaucaauagaugcuuuuauguggaacugauucggggaagaaagcaggagaccgaaguucucuggaccucuaacagcaucguggucuucuguggcacauccgggaccuacggaacaggcucuuggcccgauggggcugacauuaaucugaugccuaucuga

SEQ ID NO: 197297 - RNA, 1410 nt, Artificial Sequence; identical to SEQ ID NO: 197161
  derived and/or modified sequence opt5 from neuraminidase__InfluenzaA__AAY58319

SEQ ID NO: 197298 - RNA, 1392 nt, Artificial Sequence
  derived and/or modified sequence opt5 from neuraminidase__InfluenzaA__AAY59038
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacaaacgacaccguucaugaucggacgccguaucgcacacuccugaugaaugaacugggcgugcccuuucaccucgggaccaagcaggucuguaucgccuggucuagcuccagcugccaugacggaaaagccuggcugcacguguguguuacaggcgaugacgagaacgcuaccgcuucuuucauuuacaauggcagacuuguggauuccaucgggagcuggucuaagaaaauucugcggacccaggaauccgagugcgucuguaucaacggaacaugcacgguggugaugaccgacggcagcgccucugggaaggcggauacaaaaauucucuuuaucgaggaaggaaagaucguccauaccuccccucugagcggcuccgcccaacacguugaggaaugcucuuguuauccccgcuacccuggggugagaugcgugugucgggacaauuggaagggaagcaaccgccccauugucgauaucaacgugaaagacuacuccauuguuagcucuuaugugugcuccggccuugucggcgacacaccgagaaagaaugauagcucuagcuccucucacugucuggacccuaacaaugaggaagggggacauggcgugaaagggugggcuuucgaugacggaaacgauguuuggaugggccggaccaucagcgagaagcuccgcuccggguacgagacguuuaaagugauugaaggauggagcaagcccaauucuaaacugcagaucaacagacaggucaucguggaccggggcaaucgcuccggcuauagcgggauuuucucugucgagggaaaguccugcaucaacagauguuuuuacguggaacugauucggggcagaaagcaggagacagaaguucucuggaccagcaauuccaucguggucuucugcgggaccucuggaacauauggcaccgggagcuggccugauggcgccgacauuaaccugaugcccaucuga

SEQ ID NO: 197299 - RNA, 1410 nt, Artificial Sequence
  derived and/or modified sequence opt5 from neuraminidase__InfluenzaA__AAY64195
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuuuaucgaggaaggaaagaucauucacaucagccaacuguccggcucugcccagcaugucgaggaaugcagcuguuauccccgguacccugggguucgcugcguguguagagacaauuggaagggauccaaccggcccauuguggauaucaacgucaaagacuacagcauugugucuuccuauguuugcagcggccucgugggcgacaccccucgcaagaaugauucuagcuccucuagccacugucugaaccccaauaacgaggaagggggacauggcgucaaagggugggcuuucgacgauggaaaugacguguggaugggcagaacaaucuccgagaaguuucggagcggguacgagaccuucaaaguuaucgaaggauggucuaagccgaacuccaaacugcagauuaaucgccaggugaucgucgauagagacaaccggagcggcuauucuggcauuuuuagcguggaggggaaguccugcaucaauagauguuucuacgucgaacucauucgcggacggaagcaagaggccgaagugugguggacguccaacucuaucguuguguuuugcggcacaagcgggaccuauggaaccggcuccuggccugauggggcugacauuaaucugaugcccaucuga

SEQ ID NO: 197300 - RNA, 1410 nt, Artificial Sequence; identical to SEQ ID NO: 197159
  derived and/or modified sequence opt5 from neuraminidase__InfluenzaA__AAY64205

SEQ ID NO: 197301 - RNA, 1410 nt, Artificial Sequence; identical to SEQ ID NO: 197085
  derived and/or modified sequence opt5 from neuraminidase__InfluenzaA__AAY64215

SEQ ID NO: 197302 - RNA, 1410 nt, Artificial Sequence
  derived and/or modified sequence opt5 from neuraminidase__InfluenzaA__AAY64225
augaaccccaaucagaagaucauuaccaucggcagcgugucccugacaauugccacgaucugcuuccucaugcaaauuaccauccuggucacaaccguuacacuucacuuuaaacaguacgaguguaacccuccgcccaauaaccaggugaugcugugcgaaccuaccaucauugagagaaauaucacagaaauuguguaucucaccaacacgaccaucgagaaggaaauuugucccaaacuggcugaguaccggaauuggucuaagccucagugcaacaucacaggguucgcccccuuuagcaaagacaauuccauucgccuuucugcgggaggcgauaucugggucaccagagagccuuaugugagcugugacccggauaagugcuaccaauucgcucuggggcagggaacaacccucaacaauggccauuccaacgacacgguucacgaucggacacccuaucgcacccugcugaugaaugaacucggggugccuuuucaucugggaacaagacaggucuguaucgccuggucuagcuccagcugccacgacggcaaggccuggcuucauguguguguuaccggcgaugacgagaacgcuaccgccucuuucauuuacaaugggcggcugguggauuccaucggaagcuggucuaaaaagauucuccgcacacaggaauccgagugcgucuguaucaacggcacgugcaccguggugaugacagacgggagcgcuucuggaaaagccgauaccaagauucuguuuaucgaggaaggcaaaaucguccacauuuccacacuuagcggguccgcgcaacacguugaggaaugcucuuguuaucccagauacccuggagugcggugcgugugucgcgacaacuggaagggcagcaauagacccaucgucgauauuaacgugaaggacuacuccaucguuagcucuuaugugugcuccggccuggucggggacaccccgcggaaaaaugauagcuucucuagcucccauugucucgacccuaacaaugaggaaggaggccacggggugaagggaugggccuuugaugacggcaacgauguuuggauggggcgcacgauuucugagaaacugagaagcggauacgagacauucaaggugaucgaaggcugguccaaacccaauagcaagcugcagaucaaccggcaggucauuguggagcgcggcaauagaucuggguauuccggaaucuuuagcgucgaaggcaaaucuugcauuaaccgguguuucuacguggagcucaucagagggcgcaaggaagagaaugagguuugguggaccuccaacagcauuguggucuuuugcggaaccuccggcacauaugggaccggcucuuggccugacggagcugauaucaaucugaugcccauuuga

SEQ ID NO: 197303 - RNA, 1410 nt, Artificial Sequence
  derived and/or modified sequence opt5 from neuraminidase__InfluenzaA__AAY64245
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacgaugagaaugccaccgcuuccuucaucuacggcgggcggcugguggacagcauuggaucuugguccaaaaagauccuucgcacccaggaaagcgagugcgucuguauuaacggcacaugcacgguggugaugaccgaugggucugccuccggcagagcggacacaaaaauccuguuuauugaggaaggaaagaucauccacauuagccaacucuccgggucugcccagcaugucgaggaaugcagcuguuauccccgguacccuggaguucgcugcguguguagagauaauuggaagggcuccaaccggcccaucguggacauuaacgucaaagauuacagcaucgugucuuccuauguuugcagcggccuggugggggacaccccucgcaagaaugacucuagcuccucuagccacugucugaaccccaauaacgaggaaggaggccauggggucaaaggaugggcuuucgaugacggcaaugauguguggauggggagaacaauuuccgagaaguuucggagcggauacgagaccuucaaaguuaucgaaggcuggucuaagccgaacuccaaacuccagaucaaucgccaggugauugucgacagagauaaccggagcggcuauucugggaucuuuuccguggagggaaagagcugcauuaauagauguuucuacgucgaacugauccgcggccggaagcaagagacggaagugugguggacauccaacucuauuguuguguuuugcgggaccagcggaaccuauggcacaggguccuggccugacggcgccgauaucaaucuuaugcccauuuga

SEQ ID NO: 197304 - RNA, 1410 nt, Artificial Sequence; identical to SEQ ID NO: 197085
  derived and/or modified sequence opt5 from neuraminidase__InfluenzaA__AAY64255

SEQ ID NO: 197305 - RNA, 1410 nt, Artificial Sequence; identical to SEQ ID NO: 197303
  derived and/or modified sequence opt5 from neuraminidase__InfluenzaA__AAY64265

SEQ ID NO: 197306 - RNA, 1410 nt, Artificial Sequence; identical to SEQ ID NO: 197303
  derived and/or modified sequence opt5 from neuraminidase__InfluenzaA__AAY64285

SEQ ID NO: 197307 - RNA, 1410 nt, Artificial Sequence
  derived and/or modified sequence opt5 from neuraminidase__InfluenzaA__AAY64295
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacugagcgaguaccggaauugguccaagccccagugcaacaucaccggguucgccccuuuuucuaaagacaauagcauucgccuuuccgcgggaggcgauaucugggucacaagagagcccuaugugucuugugacccugauaagugcuaccaauucgcucuggggcagggaaccacacucaacaauggccauagcaacgacaccguucacgaucggacgccguaucgcacacugcugaugaaugaacucggggugcccuuucaucugggaaccaagcaggucuguaucgccugguccucuagcuccugccacgacggcaaagccuggcuucauguguguguuacaggcgaugacgagaacgcuaccgccagcuucauuuacaaugggagacugguggauucuaucggauccuggagcaagaaaauucuccggacccaggaaucugagugcgucuguaucaacggcacaugcacgguggugaugaccgacggguccgcuagcggaaaggccgauacaaaaauucuguuuaucgaggaaggcaagaucguccacauuuccacccuuucugggagcgcgcaacacguugaggaaugcuccuguuauccucgcuaccccggagugagaugcgugugucgggacaacuggaagggcagcaaucgcccuaucgucgauauuaacgugaaagaccauucuaucguuuccagcuacgugugcucuggccuggucggggacacacccagaaagaaugauagcuucuccucuagccacugucucgacccgaacaaugaggaaggaggccauggggugaaaggaugggccuuugaugacggcaacgauguuuggauggggcggaccauuuccgagaagcugcgcagcggauaugagacguucaaagugaucgaaggcuggucuaagccuaauuccaaacugcagaucaacagacaggucauuguggagcggggcaaucgcagcggguacucuggaaucuuuuccgucgaaggcaagagcugcauuaacagauguuucuauguggagcucauccgggggagaaaggaagagacagagguuugguggaccuccaauucuauuguggucuuuugcggaaccagcggcacauacgggaccggcuccuggcccgacggagcugauaucaaccugaugccuauuuga

SEQ ID NO: 197308 - RNA, 1410 nt, Artificial Sequence
  derived and/or modified sequence opt5 from neuraminidase__InfluenzaA__AAY64305
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacaccagcaaacuuuccggcucugcccaacauguugaggaaugcagcuguuauccucgguaccccggggugcgcugcguguguagagacaauuggaagggauccaaccggccuauugucgauaucaacgugaaggacuacagcauuguuucuuccuaugugugcagcggccuggucggcgacacaccccgcaaaaaugauucuagcuccucuagccacugucucgacccgaacaaugaggaagggggacauggcgugaaggggugggcuuucgaugacggaaacgauguuuggaugggcagaaccaucuccgagaaaagccggucuggguacgagacguuuaaggugauugaaggaugguccaaaccuaauagcaagcugcagaucaaccgccaggucaucguggagagaggcaauaugucuggcuauuccgggauuuucagcgucgaaggaaaguccugcaucaaccgguguuuuuacguggagcugauuagaggccgcaaacaggaaacagagguuugguggaccucuaauagcaucguggucuucugcgggaccuccggaacauauggcaccgggucuuggcccgacggcgccgauauuaaccucaugccuaucuga

SEQ ID NO: 197309 - RNA, 1410 nt, Artificial Sequence; identical to SEQ ID NO: 197159
  derived and/or modified sequence opt5 from neuraminidase__InfluenzaA__AAY64335

SEQ ID NO: 197310 - RNA, 1410 nt, Artificial Sequence; identical to SEQ ID NO: 197174
  derived and/or modified sequence opt5 from neuraminidase__InfluenzaA__AAY64365

SEQ ID NO: 197311 - RNA, 1410 nt, Artificial Sequence
  derived and/or modified sequence opt5 from neuraminidase__InfluenzaA__AAY64385
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacgaugagaaugccaccgcuuccuucaucuacggcgggcggcugguggacagcauuggaucuugguccaaaaagauccuucgcacccaggaaagcgagugcgucuguauuaacggcacaugcacgguggugaugaccgaugggucugccuccggcagagcggacacaaaaauccuguuuauugaggaaggaaagaucauccacauuagccaacucuccgggucugcccagcaugucgaggaaugcagcuguuauccccgguacccuggaguucgcugcguguguagagauaauuggaagggcuccaaccggcccaucguggacauuaacgucaaagauuacagcaucgugucuuccuauguuugcagcggccuggugggggacaccccucgcaagaaugacucuagcuccucuagccacugucugaaccccaauaacgaggaaggaggccauggggucaaaggaugggcuuucgaugacggcaaugauguguggauggggagaacaauuuccgaaaagagccggucuggauacgagaccuuuaaaguuaucgagggcugguccaagccgaacagcaaacuccagaucaaucgccaggugauugucgacagagauaaccggucuggcuauuccgggaucuucagcguggagggaaaguccugcauuaauagauguuuuuacgucgaacugauccgcggccggaagcaagagacggaagugugguggacaucuaacagcauuguuguguucugcgggaccuccggaaccuauggcacagggucuuggccugacggcgccgauaucaaucuuaugcccauuuga

SEQ ID NO: 197312 - RNA, 1410 nt, Artificial Sequence
  derived and/or modified sequence opt5 from neuraminidase__InfluenzaA__AAY64395
augaaccccaaucagaagaucauuaccaucggcagcgugucccugauuaucucuacaauuugcuucuuuaugcaaaucgccauccucauuacgaccgucacacugcacuucaaacaguacgaguuuaacagcccuccgaauaaccagguuaugcuuugugaacccaccaucauugagagaaauaucacagaaauuguguaucugaccaacacaaccaucgagaaggaaauuugcccuaaacucgcugaguaccggaauugguccaagccccagugugacaucacgggguucgccccuuuuucuaaagauaacagcauccgccuguccgcgggaggcgacauuugggugaccagagagcccuaugucucuugcgauccugacaaguguuaccaauucgcucuugggcagggaacaacccugaauaacgugcauagcaaugauacaguucacgaccggaccccguaucgcacgcuccugaugaacgaacugggcgugcccuuucaucucgggacaaagcaggucugcaucgccugguccucuagcuccugucacgauggaaaagccuggcugcaugugugcguuaccggcgacgaugagaaugcuacagccagcuucauuuacaacggcagacuuguggacucuaucgucuccuggagcaagaaaauucugcggacccaggaaucugagugugugugcaucaaugggaccuguacaguggucaugacggauggauccgcuagcggcaaggccgacaccaaaauccucuuuauuaaggaggggaagaucguucacacauccacccugucuggaagcgcgcaacacguggaagagugcuccugcuauccucgcuaccccggcgugagaugugucugccgggauaacuggaaagggagcaaccgcccuauuguggacaucaauauuaaggacuacucuaucguuuccagcuauguguguucuggacuugucggcgauacaccccggaaaaacgacagcuccucuagcucccauugccuggauccgaauaacgaagagggcgggcacggagugaagggcugggccuucgacgaugggaaugacguuuggaugggaagaaccaucagcgaaaaacuccgcucuggcuacgagacguuuaaggugauugaggggugguccaacagcaauucuaaacugcagaucaacagacaggucauuguggaucggggaaaucgcuccggcuauagcggcaucuucuccgucgaagggaagucuuguauuaacagaugcuuuuacguggagcugauccggggaagaaaggaagagacagaaguucucuggaccagcaauuccauuguggucuucuguggcaccucugggacauauggaaccggcagcuggccugacggggcugauaucaaccugaugcccaucuga

SEQ ID NO: 197313 - RNA, 1410 nt, Artificial Sequence; identical to SEQ ID NO: 197308
  derived and/or modified sequence opt5 from neuraminidase__InfluenzaA__AAY64405

SEQ ID NO: 197314 - RNA, 1410 nt, Artificial Sequence; identical to SEQ ID NO: 197303
  derived and/or modified sequence opt5 from neuraminidase__InfluenzaA__AAY98040

SEQ ID NO: 197315 - RNA, 1410 nt, Artificial Sequence; identical to SEQ ID NO: 197303
  derived and/or modified sequence opt5 from neuraminidase__InfluenzaA__AAY98050

SEQ ID NO: 197316 - RNA, 1410 nt, Artificial Sequence; identical to SEQ ID NO: 197195
  derived and/or modified sequence opt5 from neuraminidase__InfluenzaA__AAY98060

SEQ ID NO: 197317 - RNA, 1410 nt, Artificial Sequence
  derived and/or modified sequence opt5 from neuraminidase__InfluenzaA__AAY98070
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggaccauagcaucguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccauuagcgagaaacugagauccggauaugagaucuucaaggugaucgaaggcuggagcaaaccuaauucuaagcugcagauuaaccggcaggucaucguggagcgcggcaauagauccggguacagcggaaucuuuucugucgaaggcaaauccugcauuaaccgguguuucuauguggagcucauuagagggcgcaaggaagagacggagguuugguggacaagcaauuccaucguggucuuuugcggaaccucuggcaccuacgggacaggcagcuggcccgacggagccgauauuaaccugaugccuaucuga

SEQ ID NO: 197318 - RNA, 1410 nt, Artificial Sequence; identical to SEQ ID NO: 197203
  derived and/or modified sequence opt5 from neuraminidase__InfluenzaA__AAY98080

SEQ ID NO: 197319 - RNA, 1410 nt, Artificial Sequence
  derived and/or modified sequence opt5 from neuraminidase__InfluenzaA__AAY98090
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggaaagcggauacaaagauucuuuuuaucgaggaaggaaagaucauucacaucagccaacuguccggcucugcccagcaugucgaggaaugcagcuguuaucccagauacccugggguucggugcgugugucgcgacaauuggaaaggauccaacagacccauuguggauaucaacgucaaggacuacagcauugugucuuccuauguuugcagcggccucgugggcgacaccccucggaaaaaugauucuagcuccucuagccacugucugaaccccaauaacgaggaagggggacauggcgucaaggggugggcuuucgacgauggaaaugacguguggaugggccgcacaaucuccgagaaauuuagaagcggguacgagaccuucaagguuaucgaaggauggucuaaaccgaacuccaagcugcagauuaaucgccaggugaucgucgaucgggacaacagaagcggcuauucuggcauuuuuagcguggaggggaaguccugcaucaaucgguguuucuacgucgaacucauuagaggacgcaaacaagagacggaagugugguggacauccaacucuaucguuguguuuugcggcaccagcgggaccuauggaacaggcuccuggccugauggggccgacauuaaucugaugcccaucuga

SEQ ID NO: 197320 - RNA, 1410 nt, Artificial Sequence; identical to SEQ ID NO: 197303
  derived and/or modified sequence opt5 from neuraminidase__InfluenzaA__AAY98100

SEQ ID NO: 197321 - RNA, 1410 nt, Artificial Sequence; identical to SEQ ID NO: 197303
  derived and/or modified sequence opt5 from neuraminidase__InfluenzaA__AAY98110

SEQ ID NO: 197322 - RNA, 1410 nt, Artificial Sequence; identical to SEQ ID NO: 197303
  derived and/or modified sequence opt5 from neuraminidase__InfluenzaA__AAY98120

SEQ ID NO: 197323 - RNA, 1410 nt, Artificial Sequence; identical to SEQ ID NO: 197303
  derived and/or modified sequence opt5 from neuraminidase__InfluenzaA__AAY98130

SEQ ID NO: 197324 - RNA, 1410 nt, Artificial Sequence; identical to SEQ ID NO: 197303
  derived and/or modified sequence opt5 from neuraminidase__InfluenzaA__AAY98150

SEQ ID NO: 197325 - RNA, 1410 nt, Artificial Sequence
  derived and/or modified sequence opt5 from neuraminidase__InfluenzaA__AAY98160
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacgaugagaaugccaccgcuuccuucaucuacggcgggcggcugguggacagcauuggaucuugguccaaaaagauccuucgcacccaggaaagcgagugcgucuguauuaacggcacaugcacgguggugaugaccgaugggucugccuccggcagagcggacacaaaaauccuguuuauugaggaaggaaagaucauccacauuagccaacucuccgggaaugcccagcaugucgaggaaugcucuuguuauccccgguacccuggaguucgcugcguguguagagauaacuggaagggcagcaaccggcccaucguggacauuaaugucaaagauuacuccaucgugagcucuuauguuugcuccggccuggugggggacaccccucgcaagaacgacagcucuagcuccucuaauugucugaaccccaauaacgaggaaggaggccacggggucaaaggaugggcuuucgaugacggcaaugauguguggauggggagaacaauuagcgagaaguuucgguccggauacgagaccuucaaaguuaucgaaggcuggagcaagccgaacucuaaacuccagaucaaucgccaggugauugucgacagagauaaccgguccggcuauagcgggaucuuuucuguggagggaaaguccugcauuaauagauguuucuacgucgaacugauccgcggccggaagcaagagacggaagugugguggacaagcaacuccauuguuguguuuugcgggaccucuggaaccuauggcacagggagcuggccugacggcgccgauaucaaucuuaugcccauuuga

SEQ ID NO: 197326 - RNA, 1410 nt, Artificial Sequence; identical to SEQ ID NO: 197303
  derived and/or modified sequence opt5 from neuraminidase__InfluenzaA__AAY98170

SEQ ID NO: 197327 - RNA, 1410 nt, Artificial Sequence; identical to SEQ ID NO: 197303
  derived and/or modified sequence opt5 from neuraminidase__InfluenzaA__AAY98180

SEQ ID NO: 197328 - RNA, 1410 nt, Artificial Sequence; identical to SEQ ID NO: 197303
  derived and/or modified sequence opt5 from neuraminidase__InfluenzaA__AAY98200

SEQ ID NO: 197329 - RNA, 1410 nt, Artificial Sequence; identical to SEQ ID NO: 197303
  derived and/or modified sequence opt5 from neuraminidase__InfluenzaA__AAY98210

SEQ ID NO: 197330 - RNA, 1410 nt, Artificial Sequence; identical to SEQ ID NO: 197308
  derived and/or modified sequence opt5 from neuraminidase__InfluenzaA__AAY98220

SEQ ID NO: 197331 - RNA, 1410 nt, Artificial Sequence; identical to SEQ ID NO: 197303
  derived and/or modified sequence opt5 from neuraminidase__InfluenzaA__AAY98230

SEQ ID NO: 197332 - RNA, 1410 nt, Artificial Sequence
  derived and/or modified sequence opt5 from neuraminidase__InfluenzaA__AAY98250
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacgaugagaaugccaccgcuuccuucaucuacggcgggcggcugguggacagcauuggaucuugguccaaaaagauccuucgcacccaggaaagcgagugcgucuguauuaacggcacaugcacgguggugaugaccgaugggucugccuccggcagagcggacacaaaaauccuguuuauugaggaaggaaagaucauccacauuagccaacucuccgggucugcccagcaugucgaggaaugcagcuguuauccccgguacccuggaguucgcugcguguguagagauaauuggaagggcuccaaccggcccaucguggacauuaacgucaaagauuacagcaucgugucuuccuauguuugcagcggccuggugggggacaccccucgcaagaaugacucuagcuccucuagccacugucugaaccccaauaacgaggaaggaggccauggggucaaaggaugggcuuucgaugacggcaaugauguguggauggggagaacaauuuccgagaaguuucggagcggauacgagaccuucaaaguuaucgaaggcuggucuaagccgaacuccaaacuccagaucaaucgccaggugauugucgacagagauaaccggagcggcuauucugggaucuuuuccguggaggacaagagcugcauuaauagauguuucuacgucgaacugauccgcggacggaagcaagagacggaagugugguggacauccaacucuauuguuguguuuugcggcaccagcgggaccuauggaacaggcuccuggccugauggggccgacaucaaucuuaugcccauuuga

SEQ ID NO: 197333 - RNA, 1410 nt, Artificial Sequence; identical to SEQ ID NO: 197303
  derived and/or modified sequence opt5 from neuraminidase__InfluenzaA__AAY98322

SEQ ID NO: 197334 - RNA, 1410 nt, Artificial Sequence; identical to SEQ ID NO: 197308
  derived and/or modified sequence opt5 from neuraminidase__InfluenzaA__AAY98332

SEQ ID NO: 197335 - RNA, 1410 nt, Artificial Sequence; identical to SEQ ID NO: 197303
  derived and/or modified sequence opt5 from neuraminidase__InfluenzaA__AAY98342

SEQ ID NO: 197336 - RNA, 1410 nt, Artificial Sequence; identical to SEQ ID NO: 197303
  derived and/or modified sequence opt5 from neuraminidase__InfluenzaA__AAY98359

SEQ ID NO: 197337 - RNA, 1410 nt, Artificial Sequence; identical to SEQ ID NO: 197308
  derived and/or modified sequence opt5 from neuraminidase__InfluenzaA__AAY98369

SEQ ID NO: 197338 - RNA, 1410 nt, Artificial Sequence
  derived and/or modified sequence opt5 from neuraminidase__InfluenzaA__AAY98379
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacggcgggcggcucguggacagcaucggaucuugguccaaaaagauucugcgcacccaggaaagcgagugcgucuguaucaacggcacaugcacgguggugaugaccgaugggucugccuccggcagagcggacacaaaaauucuuuuuaucgaggaaggaaagaucauucacaucagccaacuguccgggucugcccagcaugucgaggaaugcagcuguuauccccgguacccuggaguucgcugcguguguagagauaauuggaagggcuccaaccggcccauuguggacaucaacgucaaagauuacagcauugugucuuccuauguuugcagcggccucgugggggacaccccucgcaagaaugacucuagcuccucuagccacugucugaaccccaauaacgaggaaggaggccauggggucaaaggaugggcuuucgaugacggcaaugauguguggauggggagaacaaucuccgagaaguuucggagcggauacgagaccuucaaaguuaucgaaggcuggucuaagccgaacuccaaacugcagauuaaucgccaggugaucgucgacagaaacaaucggagcggcuauucugggaucuuuuccguggagggaaagagcugcauuaacagauguuucuacgucgaacucauucgcggccggaagcaagagacggaagugugguggacauccaauucuaucguuguguuuugcgggaccagcggaaccuauggcacaggguccuggccugauggcgccgacauuaaccugaugcccaucuga

SEQ ID NO: 197339 - RNA, 1410 nt, Artificial Sequence
  derived and/or modified sequence opt5 from neuraminidase__InfluenzaA__AAY98389
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacggcgggcggcucguggacagcaucggaucuugguccaaaaagauucugcgcacccaggaaagcgagugcgucuguaucaacggcacaugcacgguggugaugaccgaugggucugccuccggcagagcggacacaaaaauucuuuuuaucgaggaaggaaagaucauucacaucagccaacuguccgggucugcccagcaugucgaggaaugcagcuguuauccccgguacccuggaguucgcugcguguguagagauaauuggaagggcuccaaccggcccauuguggacaucaacgucaaagauuacagcauugugucuuccuauguuugcagcggccucgugggggacaccccucgcaagaaugacucuagcuccucuagccacugucugaaccccaauaacgaggaaggaggccauggggucaaaggaugggcuuucgaugacggcaaugauguguggauggggagaacaaucuccgagaaguuucggagcggauacgagaccuucaaaguuaucgaaggcuggucuaagccgaacuccaaacugcagauuaaucgccaggugaucgucgacagagauaaccggagcggcuauucugggaucuuuuccguggagggaaagagcugcauuaauagauguuucuacgucgaacucauucgcggccggaagcaagagacggaagugugguggacauccaacucuaucguuguguuuugcgggaccagcggaaccuauggcacaggguccuggccugacggcgccgauauuaaucugaugcccaucuga

SEQ ID NO: 197340 - RNA, 1410 nt, Artificial Sequence; identical to SEQ ID NO: 197303
  derived and/or modified sequence opt5 from neuraminidase__InfluenzaA__AAY98399

SEQ ID NO: 197341 - RNA, 1410 nt, Artificial Sequence; identical to SEQ ID NO: 197303
  derived and/or modified sequence opt5 from neuraminidase__InfluenzaA__AAY98409

SEQ ID NO: 197342 - RNA, 1410 nt, Artificial Sequence; identical to SEQ ID NO: 197303
  derived and/or modified sequence opt5 from neuraminidase__InfluenzaA__AAY98773

SEQ ID NO: 197343 - RNA, 1410 nt, Artificial Sequence
  derived and/or modified sequence opt5 from neuraminidase__InfluenzaA__AAZ32955
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacauuguucacgaacggaccccguaucgcacgcuccugaugaaugagcugggcgugcccuuucaucucgggacaaagcaggucugcaucgccugguccucuagcuccugucacgauggaaaagccuggcugcaugugugcguuaccggcgacgaugaaaacgcuacagccagcuucauuuacaauggcagacuuguggacucuaucgucuccuggagcaagaaaauucugcggacccaggagucugagugugugugcaucaacgggaccuguacaguggucaugacggauggauccgcuagcggcaaggccgacaccaaaauccucuuuauugaagaggggaagaucguucacacauccacccugucuggaagcgcgcaacacguggaagagugcuccugcuauccucgcuaccccggcgugagaugugucugccgggauaacuggaaggggagcaaucgcccuauuguggacaucaacauuaaagauuacucuaucguuuccagcuauguguguucuggacuugucggcgacacacccagaaagaaugacagcuccucuagcucccauugccuggauccgaacaaugaagagggcgggcacggagugaaaggcugggccuucgacgaugggaacgacguuuggaugggacggaccaucagcgagaagcuccgcucuggcuacgaaacguuuaaagugauugaggggugguccaauccuaacagcaagcugcagaucaauagacaggucauuguggaucggggaaaccgcucuggcuauuccggcaucuucagcgucgaagggaaauccuguauuaauagaugcuuuuacguggagcugauccggggaagaaagcaggaaacagagguucucuggaccucuaacagcauuguggucuucuguggcaccuccgggacauauggaaccggcucuuggcccgacggggcugauaucaaucugaugccuaucuga

SEQ ID NO: 197344 - RNA, 1344 nt, Artificial Sequence
  derived and/or modified sequence opt5 from neuraminidase__InfluenzaA__AAZ32957
augaaccccaaucagaagaucauuaccaucggcagcgugucccugacaauuucuacgaucugcuucuuuaugcaaauugccauccucaucaccacagucacccugauugagagaaacaucacagaaauuguuuaccuuaccaauacaaccaucgagaaagaaauuuguccuaagcuggcugaguaucggaacuggagcaaaccgcagugcaauaucacgggguucgcccccuuuuccaaggacaacucuauucgccucagcgcgggaggcgauaucugggugaccagagaaccuuacguguccugugaccccgauaaaugcuaucaguucgcucuggggcagggaacaacccuuaauaacguccacucuaaugacacagugcaugaucggaccccuuaccgcacgcugcucaugaacgagcugggcguucccuuucaccuggggacaaagcaaguguguaucgccuggagcuccagcucuugccaugacggaaaggccuggcuccacgucugugugaccggcgaugacgagaaugcuacagccuccuucauuuauaacggcagacugguugauagcaucgugucuugguccaaaaagauucuucggacccaggaaagcgagugcgucuguaucaaugggaccugcacaguggugaugacggacggaaacgcuucuggcaaagccgauaccaagauucuguuuaucgaagaggggaaaaucguccauacauccacccucagcggauccgcgcagcacguugaggaauguucuugcuacccucgcuauccgggcgugagaugcgugugucgggacaauuggaaggggagcaaccgccccauugucgauaucaacauuaaggacuacuccaucgugagcucuuacguuugcuccggacuggugggcgacacaccucggaaaaaugauagcucuagcuccucucacugucuugaccccaacaaugaggaaggcgggcauggagucaagggcugggccuucgaugacgggaacgauguguggaugggaagaaccauuagcgagaaacugcgcuccggcuaugaaacguuuaagguuaucgagggguggagcaauccuaacucuaaacuccagaucaauagacaagugauugucgaccggggaaaccgcuccggcuacagcggcaucuucucuguggaggggaaguccugcauuaauagauguuuuuaugucgaacugauccggggaagaaaacaggagacagaagugcuguggaccagcaacuccauuguuguguucugcggcaccucugggacauacggaaccggcagcuggcccgauggggcugacaucaaucucaugccgauuuga

SEQ ID NO: 197345 - RNA, 1344 nt, Artificial Sequence; identical to SEQ ID NO: 197344
  derived and/or modified sequence opt5 from neuraminidase__InfluenzaA__AAZ32958

SEQ ID NO: 197346 - RNA, 1344 nt, Artificial Sequence; identical to SEQ ID NO: 197344
  derived and/or modified sequence opt5 from neuraminidase__InfluenzaA__AAZ32959

SEQ ID NO: 197347 - RNA, 1410 nt, Artificial Sequence; identical to SEQ ID NO: 197308
  derived and/or modified sequence opt5 from neuraminidase__InfluenzaA__AAZ38465

SEQ ID NO: 197348 - RNA, 1410 nt, Artificial Sequence; identical to SEQ ID NO: 197308
  derived and/or modified sequence opt5 from neuraminidase__InfluenzaA__AAZ38476

SEQ ID NO: 197349 - RNA, 1410 nt, Artificial Sequence
  derived and/or modified sequence opt5 from neuraminidase__InfluenzaA__AAZ38487
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaauccuggagagaaauauuaccgaaaucguguaucuuacaaacaccacgauugagaaggaaaucugucccaaacuggccgaguaccggaauuggagcaagccucagugcaaaauuaccggguucgcgcccuuuuccaaggacaacucuauccgccucagcgcuggaggcgauauuugggucacaagagagccuuauguguccugugaccccgauaagugcuaccaauucgcccuggggcagggaaccacacugaauaaccggcauucuaaugacaccguucacgaucgcacgccuuauagaacacuccugaugaacgaacuuggcgugccguuucaucuggggaccaaacaggucuguaucgccuggagcuccagcucuugccacgacggaaaggcuuggcuccauguguguguuacaggccacgaugagaaugccaccgcuuccuucaucuacggcgggcggcugguggacagcauuggaucuugguccaaaaagauccuucgcacccaggaaagcgagugcgucuguauuaacggcacaugcacgguggugaugaccgaugggucugccuccggcagagcggacacaaaaauccuguuuauugaggaaggaaagaucauccacauuagccaacucuccgggucugcccagcaugucgaggaaugcagcuguuauccccgguacccuggaguucgcugcguguguagagauaauuggaagggcuccaaccggcccaucguggacauuaacgucaaagauuacagcaucgugucuuccuauguuugcagcggccuggugggggacaccccucgcaagaaugacucuagcuccucuagcaacugucugaaucccaacaaugaggaaggaggccacggggucaaaggaugggcuuucgaugacggcaacgauguguggauggggagaacaauuuccgagaaguuucggagcggauacgagaccuucaaaguuaucgaaggcuggucuaagccuaauuccaaacuccagaucaaccgccaggugauugucgacagagauaaucggagcggcuauucugggaucuuuuccguggagggaaagagcugcauuaacagauguuucuacgucgaacugauccgcggccggaagcaagagacggaagugugguggacauccaauucuauuguuguguuuugcgggaccagcggaaccuauggcacaggguccuggccggacggcgccgauaucaaccuuaugcccauuuga

SEQ ID NO: 197350 - RNA, 1410 nt, Artificial Sequence
  derived and/or modified sequence opt5 from neuraminidase__InfluenzaA__AAZ38509
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacagcaauucuaagcugcagauuaacagacaggucaucguggaucggggaaaucgcuccggcuauagcggcauuuucuccgucgaggggaaaucuuguaucaacagaugcuuuuacguggaacugauucggggaagaaaggaggaaaccgagguucucuggaccagcaauuccaucguggucuucuguggcacaucugggaccuauggaacaggcagcuggccugacggggcugauauuaaccugaugcccaucuga

SEQ ID NO: 197351 - RNA, 1410 nt, Artificial Sequence
  derived and/or modified sequence opt5 from neuraminidase__InfluenzaA__AAZ38586
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 197352 - RNA, 1410 nt, Artificial Sequence; identical to SEQ ID NO: 197351
  derived and/or modified sequence opt5 from neuraminidase__InfluenzaA__AAZ38597

SEQ ID NO: 197353 - RNA, 1410 nt, Artificial Sequence
  derived and/or modified sequence opt5 from neuraminidase__InfluenzaA__AAZ38608
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaugugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcaucgccugguccucuagcuccugucacgauggaaaagccuggcugcaugugugcguuacaggcgacgauaagaaugcuaccgccagcuucauuuacaacggcagacuuguggacucuaucgucuccuggagcaaaaagauucugcggacccaggagucugaaugugugugcaucaaugggacauguacgguggucaugaccgauggauccgcuagcggcaaagccgacacaaagauucucuuuaucgaggaggggaagaucauucacaccuccacacugucuggaagcgcgcaacacguugaagagugcuccugcuauccucgcuaccccggcgugagaugugugugccgggauaacuggaaagggagcaaccgcccuaucgucgacauuaauaucaaggacuacucuauuguguccagcuauguuuguucuggacuugugggcgauacccccagaaagaacgacagcuccucuagcucccauugccuggauccgaauaacgaagagggcgggcacggagucaaaggcugggccuucgacgaugggaaugacguguggaugggacggacgaucagcgaaaaacuccgcucuggcuacgagacauuuaagguuaucgaggggugguccaaaccuaacagcaagcugcagauuaauagacaggugaucgucgaucggggaaaccgcucuggcuauuccggcauuuucagcguggaagggaaguccuguaucaauagaugcuuuuacgucgagcugauucggggaagaaaagaagagaccgaagugcucuggaccucuaacagcaucguuguguucuguggcacauccgggaccuauggaacaggcucuuggcccgacggggcugauacgaaucugaugccuauuuga

SEQ ID NO: 197354 - RNA, 1410 nt, Artificial Sequence
  derived and/or modified sequence opt5 from neuraminidase__InfluenzaA__AAZ38619
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaugugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcaucgccugguccucuagcuccugucacgauggaaaagccuggcugcaugugugcguuacaggcgacgauaagaaugcuaccgccagcuucauuuacaacggcagacuuguggacucuaucgucuccuggagcaaaaagauucugcggacccaggagucugaaugugugugcaucaaugggacauguacgguggucaugaccgauggauccgcuagcggcaaagccgacacaaagauucucuuuaucgaggaggggaagaucauucacaccuccacacugucuggaagcgcgcaacacguugaagagugcuccugcuauccucgcuaccccggcgugagaugugugugccgggauaacuggaaagggagcaaccgcccuaucgucgacauuaauaucaaggacuacucuauuguguccagcuauguuuguucuggacuugugggcgauacccccagaaagaacgacagcuccucuagcucccauugccuggauccgaauaacgaagagggcgggcacggagucaaaggcugggccuucgacgaugggaaugacguguggaugggacggacgaucagcgaaaaacuccgcucuggcuacgagacauuuaagguuaucgaggggugguccaaaccuaacagcaagcugcagauuaauagacaggugaucgucgaucggggaaaccgcucuggcuauuccggcauuuucagcguggaagggaaguccuguaucaauagaugcuuuuacgucgagcugauucggggaagaaaagaagagaccgaagugcucuggaccucuaacagcaucguuguguucuguggcacauccgggaccuauggaacaggcucuuggcccgacggggcugauauuaaucugaugccuaucuga

SEQ ID NO: 197355 - RNA, 1410 nt, Artificial Sequence; identical to SEQ ID NO: 197351
  derived and/or modified sequence opt5 from neuraminidase__InfluenzaA__AAZ38641

SEQ ID NO: 197356 - RNA, 1410 nt, Artificial Sequence; identical to SEQ ID NO: 197351
  derived and/or modified sequence opt5 from neuraminidase__InfluenzaA__AAZ38653

SEQ ID NO: 197357 - RNA, 1410 nt, Artificial Sequence; identical to SEQ ID NO: 197142
  derived and/or modified sequence opt5 from neuraminidase__InfluenzaA__AAZ43386

SEQ ID NO: 197358 - RNA, 1410 nt, Artificial Sequence
  derived and/or modified sequence opt5 from neuraminidase__InfluenzaA__AAZ43397
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagcgggaaauuuguccuaagcuggccgaguaucgcaauuggagcaaaccccagugcaacaucaccggguucgcgccuuuuuccaaggacaauucuauuagacuuagcgcuggaggcgauaucugggucacacgggagcccuacguguccugugacccugauaaaugcuaucaauucgcccuggggcagggaaccacacucaacaauggccacucuaacgacaccguucaugaucgcacgccguacagaacacugcugaugaaugaacucggggugcccuuucaccugggaacccggcaggucuguaucgccuggagcuccagcucuugccaugacggcaaggcuuggcuucacguguguguuacaggcgaugacaagaacgccaccgcuuccuucauuuauaaugggcgccugguggauagcaucggaucuugguccaaaaagauucucagaacccaggagagcgaaugcgucuguaucaacggcacaugcacgguggugaugaccgacgggucugccuccggaaaagcggauacaaagauucuguuuaucgaggagggcaaaaucguccacauuagcacccuuuccgggucugcccaacauguugaagagugcagcuguuacccucgguaucccggagugcgcugcguguguagagacaacuggaagggcuccaaucggccuaucgucgauauuaacgugaaggacuacagcaucguuucuuccuacgugugcagcggccuggucggggacacaccccgcaaaaaugauucuagcuccucuagccacugucucgacccgaacaaugaagagggaggccauggggugaagggaugggcuuucgaugacggcaacgauguuuggauggggagaaccauuuccgaaaaacugcggagcggauaugagacguuuaaggugaucgagggcuggucuaaaccuaauuccaagcugcagacaaaccgccaggucaucguggaaagaggcaaucggagcggguacucuggaauuuucuccgucgagggcaaaagcugcaucaacagauguuuuuauguggaacucauucgcgggcggaaggaggaaaccgagguuugguggaccuccaauucuaucguggucuucugcggaacaagcggcaccuacgggacaggcuccuggcccgacggagccgauauuaaccugaugccuaucuga

SEQ ID NO: 197359 - RNA, 1410 nt, Artificial Sequence
  derived and/or modified sequence opt5 from neuraminidase__InfluenzaA__AAZ43408
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaugaucgagagaaauauuaccgaaaucguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucaucuacaaugggagacugguggauagcauuggaucuugguccaagaaaauccuccggacccaggaaagcgagugcgucuguauuaacggcacaugcacgguggugaugaccgacgggucugccuccggaaaggcggauacaaaaauccuguuuauugaggaaggcaagaucguccacaccagcucccuuucugggagcgcccaacacguugaggaaugcuccuguuauccucgcuaccccggagugagaugcgugugucgggacaacuggaagggcagcaaucgcccuaucgucgauauuaacgugaaagacuacucuaucguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccauuagcgagaagcugcgcucuggauacgagacguuuaaagugaucgaaggcugguccaagccuaauagcaaacugcagauuaacagacaggucaucguggaccggggcaaucgcucuggguauuccggaaucuucagcgucgaguccaagucuugcauuaacagauguuuuuacguggaacucauccggggcagaaagcaggagacagaaguucuguggaccagcaauuccauuguggucuucugcgggaccucuggaacauauggcaccgggagcuggcccgauggcgccgacaucaaccuuaugccuauuuga

SEQ ID NO: 197360 - RNA, 1410 nt, Artificial Sequence
  derived and/or modified sequence opt5 from neuraminidase__InfluenzaA__AAZ74355
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggccaugcccugcgaaccugcgaucauugagagaaauacaaccgaaacaguguaccugaccaacacgaccaucgagaaggaaauuugucccaaacucgcugaguaucggaauuggagcaagccucagugcaacaucacaggguucgcccccuuuuccaaagacaauucuauucgccugagcgccggaggcgauaucugggugaccagagagccuuacgucuccugugacccggauaagugcuaucaauucgcucuugggcagggaacaacccugaacaauggccacucuaacgacacggugcaugaucggacacccuaccgcacccuccugaugaaugaacuggggguuccuuuucaccucggaacaagacagguguguauugccuggagcuccagcucuugccaugacggcaaggcuuggcugcacgucugugugaccggcgaugacgagaacgccaccgcguccuucaucuauaaugggcggcuuguugauagcaucggaucuugguccaaaaagauucugcgcacacaggaaagcgagugcguguguaucaacggcacgugcaccgucgugaugacagacgggucugccuccggaaaagcugauaccaagauucucuuuaucgaggaaggcaaaauugugcacaucagcacacuguccgggucugcccaacaugucgaggaaugcagcuguuaccccagauauccuggaguucggugcgugugucgcgacaacuggaagggcuccaauagacccaucguggauauuaacgucaaggacuacagcaucgugucuuccuacguuugcagcggccuugugggggacaccccgcggaaaaaugauucuuucagcuccucucacugucuggacccuaacaaugaggaaggaggccauggggucaagggaugggcuuuugaugacggcaacgauguguggauggggcgcacgauuagcgagaaacucagauccggauaugagacauucaagguuaucgaaggcuggagcaaacccaauucuaagcugcagauuaaccgccaggugaucgucgagcggggcaauagauccggguacagcggaaucuuuucuguggaaggcaaauccugcauuaaccgguguuucuaugucgagcugaucagagggcgcaaggaagagaccgaggugugguggaccagcaauuccauuguuguguuuugcggaacaucuggcaccuacgggacaggcagcuggccugacggagccgauaucaaccucaugcccauuuga

SEQ ID NO: 197361 - RNA, 1410 nt, Artificial Sequence
  derived and/or modified sequence opt5 from neuraminidase__InfluenzaA__AAZ74366
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggaaagcggauacaaagauucuuuuuaucgaggaaggaaagaucauucacaucagccaacuguccggcucugcccagcaugucgaggaaugcagcuguuaucccagauacccugggguucggugcgugugucgcgacaauuggaaaggauccaacagacccauuguggauaucaacgucaaggacuacagcauugugucuuccuauguuugcagcggccucgugggcgacaccccucggaaaaaugauucuagcuccucuagccacugucugaaccccaauaacgaggaagggggacauggcgucaaggggugggcuuucgacgauggaaaugacguguggaugggccgcacaaucuccgagaaauuuagaagcggguacgagaccuucaagguuaucgaaggauggucuaaaccgaacuccaagcugcagauuaaucgccaggugaucgucgauaaggacaaccggagcggcuauucuggcaucuuuuccguggaggggaaaagcugcauuaauagauguuucuacgucgaacucauucggggaagaaagcaagagacggaagugugguggacauccaacucuaucguuguguuuugcggcaccagcgggaccuauggaacaggcuccuggccugauggggccgacauuaaucugaugcccaucuga

SEQ ID NO: 197362 - RNA, 1410 nt, Artificial Sequence
  derived and/or modified sequence opt5 from neuraminidase__InfluenzaA__AAZ74377
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucaacggcacgugcaccguggugaugacagacgggucugccuccggaaaagcggauaccaagauucuguuuaucgaggagggcaagaucguccacacaagccuucuguccgggucugcccaacacguugaagagugcagcuguuauccucgcuaccccggagugagaugcgugugucgggacaacuggaaaggcuccaaucgcccuauugucgauaucaacgugaaggacuacagcauuguuucuuccuaugugugcagcggccucgucggggacacccccagaaagaaugauucuagcuccucuagccauugucuggacccgaacaaugaagagggaggccacggggugaaaggaugggcuuucgaugacggcaacgauguuuggauggggcggacgauccgcgaaaaacugagauccggauacgagacauuuaaggugauugagggcuggagcaaaccuaauucuaagcuccagaucaaccggcaggucaucguggaccgcgauaauagauccggcuauagcgggauuuucucugucgaaggaaaguccugcaucaaccgguguuuuuacguggagcugauuagaggccgcaaucaggaaaccgagguucuuuggaccagcaacuccaucguggucuucugcgggacaucuggaaccuauggcacagggagcuggcccgacggcgccgauauuaaucugaugccuaucuga

SEQ ID NO: 197363 - RNA, 1410 nt, Artificial Sequence
  derived and/or modified sequence opt5 from neuraminidase__InfluenzaA__AAZ74400
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuucccugauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuucaucgaggaaggaaagaucguccacaccagcaagcuguccggcucugcccaacauguugaggaaugcagcuguuauccucgguaccccggggugcgcugcguguguagagacaauuggaaaggauccaaccggccuauugucgauaucaacgugaaggacuacagcauuguuucuuccuaugugugcagcggccucgucggcgacacaccccgcaaaaaugauucuagcuccucuagccacugucuggacccgaacaaugaggaagggggacauggcgugaaggggugggcuuuugaugacggaaacgauguuuggaugggcagaaccaucuccgagaaaagccggucuggguacgagacguucaaggugauugaaggaugguccaaaccuaauagcaagcugcagaucaaccgccaggucaucguggagagaggcaauaugucuggcuauuccgggauuuuuagcgucgaaggaaaguccugcaucaaccgguguuucuacguggagcucauuagaggccgcaaacaggaaacagagguuugguggaccucuaauagcaucguggucuuuugcgggaccuccggaacauauggcaccgggucuuggcccgacggcgccgauauuaaccugaugccuaucuga

SEQ ID NO: 197364 - RNA, 1410 nt, Artificial Sequence; identical to SEQ ID NO: 197303
  derived and/or modified sequence opt5 from neuraminidase__InfluenzaA__AAZ74411

SEQ ID NO: 197365 - RNA, 1410 nt, Artificial Sequence
  derived and/or modified sequence opt5 from neuraminidase__InfluenzaA__AAZ74422
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaaugauaccguucacgaccggacgcccuaucgcacacugcucaugaacgaacugggcgugccuuuucaucuggggaccaagcaggucugcauugccugguccucuagcuccugucacgauggaaaagccuggcuccaugugugcguuacaggcgacgauaagaaugcuaccgccagcuucaucuacaacggcagacugguggacucuauugucuccuggagcaaagagauccuucggacccaggaaucugagugugugugcauuaaugggacaugugcuguggucaugacggauggauccgccagcggcaaggcggacaccaaaauccuguuuaucgaggaagggaagauuguucacacauccaagcucucuggaagcgcccaacacguggaggaaugcuccugcuauccccgcuacccuggcaucagaugugugugccgggauaacuggaaagggagcaaccgccccauugucgacaucaauauuaaggacuacucuaucguguccagcuauguuuguucuggacuggugggcgauaccccgcggaaaaacgacagcuccucuagcucccauugccuugauccuaauaacgaggaaggcgggcacggagucaagggcugggcuuucgacgaugggaaugacguguggaugggaagaacaaucagcgagaaacugcgcucuggcuacgagaccuuuaagguuauugaagggugguccaaccccaauagcaaacuccagaucaacagacaggugauugucgaucggggaaaucgcucuggcuauuccggcaucuucagcguggaggggaaguccuguauuaacagaugcuuuuacgucgaacugauccggggaagaaaggaggaaacggaggugcuguggacaucuaauagcauuguuguguucuguggcaccuccgggaccuauggaacaggcucuuggccugacggggccgauaucaaccucaugcccaucuga

SEQ ID NO: 197366 - RNA, 1410 nt, Artificial Sequence; identical to SEQ ID NO: 197351
  derived and/or modified sequence opt5 from neuraminidase__InfluenzaA__AAZ74444

SEQ ID NO: 197367 - RNA, 1410 nt, Artificial Sequence
  derived and/or modified sequence opt5 from neuraminidase__InfluenzaA__AAZ74455
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaaugugugugcauuaaugggacauguacgguggucaugaccgacggauccgcuagcggcaaggccgauacaaaaauccucuuuaucgaggaggggaagauuguucacaccuccacacugucuggaagcgcgcaacacguggaagagugcuccugcuauccucgcuaccccggcgugagaugugucugccgggacaacuggaaggggagcaaccgcccuaucguggacauuaauaucaaagauuacucuauuguuuccagcuauguguguucuggacuugucggcgacacccccagaaagaacgauagcuccucuagcucccauugccuggacccgaauaacgaagagggcgggcacggagugaaaggcugggccuucgaugacgggaaugauguuuggaugggacggacgaucagcgaaaagcuccgccugggcuacgagacauuuaaagugaucgagggguggucuaacccuaauuccaagcugcagauuaacagacaggucaucguggaacggggaaaucgcagcggcuauucuggcauuuucuccgucgaggggaaaagcuguaucaacagaugcuuuuacguggaacucauucggggaagaaaggaggaaaccgagguucuguggaccuccaauucuaucguggucuucuguggcacaagcgggaccuauggaacaggcuccuggcccgacggggcugauauuaaccuuaugccuaucuga

SEQ ID NO: 197368 - RNA, 1410 nt, Artificial Sequence; identical to SEQ ID NO: 197351
  derived and/or modified sequence opt5 from neuraminidase__InfluenzaA__AAZ74477

SEQ ID NO: 197369 - RNA, 1410 nt, Artificial Sequence; identical to SEQ ID NO: 197367
  derived and/or modified sequence opt5 from neuraminidase__InfluenzaA__AAZ74488

SEQ ID NO: 197370 - RNA, 1410 nt, Artificial Sequence
  derived and/or modified sequence opt5 from neuraminidase__InfluenzaA__AAZ74499
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacaugugcuguggucaugacggauggauccgccagcggcaaggcggacaccaaaauccucuuuaucgaggaagggaagauuguucacacauccaagcugucuggaagcgcccaacacguggaggaaugcuccugcuauccucgcuaccccggcaucagaugugugugccgggauaacuggaaagggagcaaccgcccuauugucgacaucaauauuaaggacuacucuaucguguccagcuauguuuguucuggacuugugggcgauacccccagaaagaacgacagcuccucuagcucccauugccuggauccgaauaacgaggaaggcgggcacggagucaaaggcugggcuuucgacgaugggaaugacguguggaugggacggacaaucagcgagaaacuccgcucuggcuacgagaccuuuaagguuauugaagggugguccaacccuaauagcaaacugcagaucaacagacaggugauugucgaucggggaaaucgcucuggcuauuccggcaucuucagcguggaggggaaguccuguauuaacagaugcuuuuacgucgaacugauccggggaagaaaggaggaaacggaggugcucuggacaucuaauagcauuguuguguucuguggcaccuccgggaccuauggaacaggcucuuggcccgacggggccgauaucaaccugaugccuaucuga

SEQ ID NO: 197371 - RNA, 1410 nt, Artificial Sequence; identical to SEQ ID NO: 197367
  derived and/or modified sequence opt5 from neuraminidase__InfluenzaA__AAZ74510

SEQ ID NO: 197372 - RNA, 1410 nt, Artificial Sequence; identical to SEQ ID NO: 197370
  derived and/or modified sequence opt5 from neuraminidase__InfluenzaA__AAZ74521

SEQ ID NO: 197373 - RNA, 1410 nt, Artificial Sequence
  derived and/or modified sequence opt5 from neuraminidase__InfluenzaA__AAZ74532
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaaugugugugcauuaaugggacauguacgguggucaugaccgacggauccgcuagcggcaaggccgauacaaaaauccucuuuaucgaggaggggaagauuguucacaccuccacacugucuggaaacgcgcaacacguggaagagugcagcugcuauccucgcuaccccggcgugagaugugucugccgggacaacuggaagggguccaaucgcccuaucguggacauuaacaucaaagauuacagcauuguuucuuccuauguguguagcggacuugucggcgacacccccagaaagaaugauucuagcuccucuagccauugccuggacccgaacaaugaagagggcgggcacggagugaaaggcugggccuucgaugacgggaacgauguuuggaugggacggacgaucuccgaaaagcuccgccugggcuacgagacauuuaaagugaucgagggguggagcaauccuaacucuaagcugcagauuaauagacaggucaucguggaacggggaaaccgcuccggcuauagcggcauuuucucugucgaggggaaauccuguaucaauagaugcuuuuacguggaacucauucggggaagaaaggaggaaaccgagguucuguggaccagcaacuccaucguggucuucuguggcacaucugggaccuauggaacaggcagcuggcccgacggggcuaauauuaaccuuaugccuaucuga

SEQ ID NO: 197374 - RNA, 1410 nt, Artificial Sequence; identical to SEQ ID NO: 197351
  derived and/or modified sequence opt5 from neuraminidase__InfluenzaA__AAZ74543

SEQ ID NO: 197375 - RNA, 1410 nt, Artificial Sequence; identical to SEQ ID NO: 197303
  derived and/or modified sequence opt5 from neuraminidase__InfluenzaA__AAZ74565

SEQ ID NO: 197376 - RNA, 1410 nt, Artificial Sequence; identical to SEQ ID NO: 197351
  derived and/or modified sequence opt5 from neuraminidase__InfluenzaA__AAZ74598

SEQ ID NO: 197377 - RNA, 1410 nt, Artificial Sequence
  derived and/or modified sequence opt5 from neuraminidase__InfluenzaA__AAZ74609
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccaucauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugauaagugcuaccaauucgcccuggggcagggaacaacccucaauaaccggcauucuaaugacacaguucacgaucgcaccccguauagaacgcugcugaugaacgaacucggcgugcccuuucaucuggggacaaaacaggucuguauugccuggagcuccagcucuugccacgacggaaaggcuuggcuucauguguguguuaccggccacgaugagaaugccacagcuuccuucaucuacgacggccggcugguggauagcauuucuuccuggagcaaaaacauccuccgcacccaggaaucugagugcgucuguauuaaugggaccugcacaguggugaugacggacggauccgccagcgagagagcggauaccaagauccuguuuaucgaagagggcaaaauuguccacaucuccccucuuucugggagcgcccaacauguugaagagugcuccuguuauccccgguacccuggagugcgcugcguguguagagacaacuggaagggcagcaaccggcccauugucgauaucaaugugaaggacuacucuauuguuuccagcuaugugugcucugggcuggucggagacacaccgcgcaaaaacgauagcuccucuagcuccuacugucucaauccuaacaaugaagagggcggccacggggugaagggaugggcuuucgacgauggcaacgacguuuggauggggagaaccaucagcgagaaacugcggucuggauaugaaacauuuaaggugaucggcgggugguccaaacccaauagcaagcugcagauuaaccgccaggucaucguggauagaggaaaucggucuggcuacuccggcauuuucagcgucgaggggaaauccugcgugaacagauguuuuuauguugaacucauccgcggacggaagcaggagaccgaagugugguggacgucuaauagcauugucguguucugcggcacauccgggaccuacggaaccggcucuuggccugacggggccgauaucaaccugaugcccauuuga

SEQ ID NO: 197378 - RNA, 1410 nt, Artificial Sequence; identical to SEQ ID NO: 197085
  derived and/or modified sequence opt5 from neuraminidase__InfluenzaA__AAZ74620

SEQ ID NO: 197379 - RNA, 1410 nt, Artificial Sequence; identical to SEQ ID NO: 197197
  derived and/or modified sequence opt5 from neuraminidase__InfluenzaA__AAZ79508

SEQ ID NO: 197380 - RNA, 1410 nt, Artificial Sequence
  derived and/or modified sequence opt5 from neuraminidase__InfluenzaA__AAZ79519
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaauccucgagagaaauauuaccgaaaucguguaucugacaaacaccacgauugagaaggaaaucuguccuaaacuugccgaguaccggaauuggagcaagccccagugcaaaauuaccggguucgcgccuuuuuccaaggacaacucuauccgccugagcgcuggaggcgauauuugggucacaagagagcccuauguguccugugacccugauaagugcuaccaauucgcccucgggcagggaaccacacugaauaaccggcauucuaaugacaccguucacgaucgcacgccguauagaacacugcucaugaacgaacugggcgugcccuuucaucuugggaccaaacaggucuguaucgccuggagcuccagcucuugccacgacggaaaggcuuggcugcauguguguguuacaggccacgauaaaaaugccaccgcuuccuucaucuacggcgggcggcucguggacagcauuggaucuugguccaagaaaauccugcgcacccaggagagcgaaugcgucuguauuaacggcacaugcacgguggugaugaccgaugggucugccuccggcagagcggacacaaagauccuuuuuauugaggagggaaagaucauccacauuagccaacuguccgggucugcccagcaugucgaagagugcagcuguuauccucgguaccccggaguucgcugcguguguagagauaauuggaaaggcuccaaccggccuaucguggacauuaacgucaaggauuacagcaucgugucuuccuauguuugcagcggccucgugggggacacaccccgcaaaaaugacucuagcuccucuagccacugucugaacccgaauaacgaagagggaggccauggggucaagggaugggcuuucgaugacggcaaugauguguggauggggagaaccauuuccgaaaaauuucggagcggauacgagaccuucaagguuaucgagggcuggucucgcccuaacuccaaacugcagaucaauagacaggugauugucgaccgggauaacagaagcggcuauucugggaucuuuuccguggaaggaaagagcugcauuaaucgcuguuucuacgucgagcucauccggggcagaaagcaagaaacggaggugugguggacauccaacucuauuguuguguuuugcgggaccagcggaaccuauggcacaggguccuggcccgacggcgccgauaucaaucugaugccuauuuga

SEQ ID NO: 197381 - RNA, 1410 nt, Artificial Sequence; identical to SEQ ID NO: 197161
  derived and/or modified sequence opt5 from neuraminidase__InfluenzaA__AAZ79530

SEQ ID NO: 197382 - RNA, 1410 nt, Artificial Sequence
  derived and/or modified sequence opt5 from neuraminidase__InfluenzaA__AAZ79552
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccgcaucgcacacugcugaugaaugaacucggggugcccuuucaccugggaaccaagcaggucuguaucgccuggagcuccagcucuugccaugacggcaaggcuuggcuucacguguguguuacaggcgaugacaaaaacgccaccgcuuccuucauuuauaaugggagacugguggauagcaucggaucuugguccaaaaagauucuccggacccaggagagcgaaugcgucuguaucaacggcacaugcacgguggugaugaccgacgggucugccuccggaaaagcggauacaaagauucuguuuaucgaggagggcaagaucguccacaccagccuucuguccgggucugcccaacauguugaagagugcagcuguuacccucgcuaucccggagugagaugcgugugucgggacaacuggaaaggcuccaaucgcccuauugucgauaucaacgugaaggacuacagcauuguuucuuccuacgugugcagcggccucgucggggacacaccccggaaaaaugauucuagcuccucuagccacugucuggacccgaacaaugaagagggaggccauggggugaagggaugggcuuucgaugacggcaacgauguuuggauggggagaaccaucuccgaaaaacugcgcagcggauaugagacguuuaaggugauugagggcuggucuaaaccuaauuccaagcuccagaucaacagacaggucaucguggaccgggauaaucgcagcggcuacucugggauuuucuccgucgaaggaaagagcugcaucaacagauguuuuuauguggagcugauucggggcagaaaucaggaaacagagguucuuuggaccuccaacucuaucguggucuucugcgggaccagcggaacauacggcaccggguccuggcccgacggcgccgauauuaaucugaugccuaucuga

SEQ ID NO: 197383 - RNA, 1410 nt, Artificial Sequence; identical to SEQ ID NO: 197303
  derived and/or modified sequence opt5 from neuraminidase__InfluenzaA__AAZ79563

SEQ ID NO: 197384 - RNA, 1410 nt, Artificial Sequence; identical to SEQ ID NO: 197303
  derived and/or modified sequence opt5 from neuraminidase__InfluenzaA__AAZ79574

SEQ ID NO: 197385 - RNA, 1410 nt, Artificial Sequence; identical to SEQ ID NO: 197303
  derived and/or modified sequence opt5 from neuraminidase__InfluenzaA__AAZ79585

SEQ ID NO: 197386 - RNA, 1410 nt, Artificial Sequence; identical to SEQ ID NO: 197370
  derived and/or modified sequence opt5 from neuraminidase__InfluenzaA__AAZ79618

SEQ ID NO: 197387 - RNA, 1410 nt, Artificial Sequence; identical to SEQ ID NO: 197351
  derived and/or modified sequence opt5 from neuraminidase__InfluenzaA__AAZ79633

SEQ ID NO: 197388 - RNA, 1410 nt, Artificial Sequence; identical to SEQ ID NO: 197370
  derived and/or modified sequence opt5 from neuraminidase__InfluenzaA__AAZ79945

SEQ ID NO: 197389 - RNA, 1410 nt, Artificial Sequence; identical to SEQ ID NO: 197367
  derived and/or modified sequence opt5 from neuraminidase__InfluenzaA__AAZ79966

SEQ ID NO: 197390 - RNA, 1410 nt, Artificial Sequence; identical to SEQ ID NO: 197351
  derived and/or modified sequence opt5 from neuraminidase__InfluenzaA__AAZ79977

SEQ ID NO: 197391 - RNA, 1410 nt, Artificial Sequence; identical to SEQ ID NO: 197351
  derived and/or modified sequence opt5 from neuraminidase__InfluenzaA__AAZ79988

SEQ ID NO: 197392 - RNA, 1410 nt, Artificial Sequence
  derived and/or modified sequence opt5 from neuraminidase__InfluenzaA__AAZ79999
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugugucuugcgauccugacaaguguuaccaauucgcucuugggcagggaaccacacugaauaacguccauagcaaugauaccgugcacgaccggacgccguaucgcacacuccugaugaacgaacugggcguucccuuucaucucgggaccaaacaggugugcauugccugguccucuagcuccugucacgauggaaaggccuggcugcaugucugcgugacaggcgacgauaagaaugcuaccgccagcuucaucuacaacggcagacuuguugacucuauuguguccuggagcaaagauauccugcggacccaggagucugaaugugucugcauuaaugggacauguacgguggugaugaccgacggauccgcuagcggcaaggccgauacaaaaauccucuuuaucgaggaggggaagauuguccacaccuccacacugucuggaagcgcgcaacacguugaagagugcuccugcuauccucgcuaccccggcgugagaugugugugccgggacaacuggaaggggagcaaccgcccuaucgucgacauuaauaucaaagauuacucuauuguguccagcuauguuuguucuggacuugugggcgacacccccagaaagaacgauagcuccucuagcucccauugccuggacccgaauaacgaagagggcgggcacggagucaaaggcugggccuucgaugacgggaaugauguguggaugggacggacgaucagcgaaaagcuccgccugggcuacgagacauuuaaaguuaucgagggguggucuaacccuaauuccaagcugcagauuaacagacaggugaucgucgaacggggaaaucgcagcggcuauucuggcauuuucuccguggaggggaaaagcuguaucaacagaugcuuuuacgucgaacucauucggggaagaaaggaggaaaccgaggugcuguggaccuccaauucuaucguuguguucuguggcacaagcgggaccuauggaacaggcuccuggcccgacggggcugauauuaaccuuaugccuaucuga

SEQ ID NO: 197393 - RNA, 1410 nt, Artificial Sequence; identical to SEQ ID NO: 197139
  derived and/or modified sequence opt5 from neuraminidase__InfluenzaA__AAZ80010

SEQ ID NO: 197394 - RNA, 1410 nt, Artificial Sequence
  derived and/or modified sequence opt5 from neuraminidase__InfluenzaA__AAZ80021
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcguuacaggcgacgauaagaaugcuaccgccagcuucaucuacaacggccggcuuguggacucuauugucuccuggagcaaagagauccugcgcacccaggaaucugagugugugugcauuaaugggacaugugcuguggucaugacggauggauccgccagcggcaaggcggacaccaaaauccucuuuaucgaggaagggaagauuguucauacauccaagcugucuggaagcgcccaacacguggaggaaugcuccugcuauccuagauaccccggcauccggugugugugccgcgauaacuggaaagggagcaacagaccuauugucgacaucaauauuaaggacuacucuaucguguccagcuauguuuguucuggacuugugggcgauacaccccggaaaaacgacagcuccucuagcucccacugccuggauccgaauaacgaggaaggcgggcauggagucaagggcugggcuuucgacgaugggaaugacguguggaugggacgcaccaucagcgagaaacucagaucuggcuacgagaccuuuaagguuauugaagggugguccaacccuaauagcaaacugcagaucaaccgccaggugauugucgaucggggaaauagaucuggcuauuccggcaucuucagcguggaggggaaguccuguauuaaccggugcuuuuacgucgaacugaucagaggacgcaaggaggaaacggaggugcucuggacaucuaauagcauuguuguguucuguggcaccuccgggaccuauggaacaggcucuuggcccgacggggccgauaucaaccugaugccuaucuga

SEQ ID NO: 197395 - RNA, 1410 nt, Artificial Sequence
  derived and/or modified sequence opt5 from neuraminidase__InfluenzaA__AAZ83245
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucaguguaacauuaccggguucgcccccuuuuccaaagacaauucuauccgccugagcgcgggaggcgauaucugggugacaagagagccuuaugucuccugcgacccggauaaguguuaccaauucgcucuugggcagggaaccacacugaacaaugugcauucuaacgacaccguucacgaucggacgcccuaucgcacacuccugaugaaugaacugggcgugccuuuucaucucgggaccaagcaggucugcauugccuggagcuccagcucuugucacgacggaaaagccuggcugcaugugugcguuacaggcgaugacgagaacgcuaccgccuccuucaucuacaauggcagacuuguggauagcauugucucuugguccaagaaaauccugcggacccaggaaagcgagugugugugcauuaacgggacauguacgguggucaugaccgacggaucugcuuccggcaaggccgauacaaaaauccucuuuaucgaggaagggaagauuguucacaccagcacacuguccggaucugcgcaacacguggaggaaugcagcugcuauccccgcuacccuggcgugagaugugucugccgggacaacuggaagggguccaaucgccccaucguggauauuaacaucaaagacuacagcauuguuucuuccuauguguguagcggacuugucggcgacaccccgagaaagaaugauucuagcuccucuagccauugccuggacccuaacaaugaggaaggcgggcacggagugaaaggcugggccuucgaugacgggaacgauguuuggaugggacggacgaucuccgagaagcuccgcagcggcuacgagacauuuaaagugaucgaaggguggucuaaucccaacuccaagcugcagauuaauagacaggucaucguggaccgggauaaccgcagcggauauucuggcauuuucuccgucgagggcaaaagcuguaucaauagaugcuuuuacguggaacugauucgggggagaaaccaggagaccgaaguucucuggaccuccaauucuaucguggucuucuguggaacaagcggcaccuaugggacaggauccuggccugacggcgcugauauuaaccugaugcccaucuga

SEQ ID NO: 197396 - RNA, 1413 nt, Artificial Sequence
  derived and/or modified sequence opt5 from neuraminidase__InfluenzaA__AAZ83256
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcgauuaccgauuggagcggcuacuccggaucuuuugugcagcauccggaacucacaggccuggacugcauccgcccuuguuucuggguugagcuugugagagggcugccccgggaaaacaccacgaucuggacaagcggauccucuauuagcuucugcggcaucgauuccgacaccgccaauuggagcuggccugauggggcugagcuccccuuuaccauugacaaauga

SEQ ID NO: 197397 - RNA, 1410 nt, Artificial Sequence; identical to SEQ ID NO: 197303
  derived and/or modified sequence opt5 from neuraminidase__InfluenzaA__AAZ83269

SEQ ID NO: 197398 - RNA, 1410 nt, Artificial Sequence; identical to SEQ ID NO: 197303
  derived and/or modified sequence opt5 from neuraminidase__InfluenzaA__AAZ83280

SEQ ID NO: 197399 - RNA, 1410 nt, Artificial Sequence; identical to SEQ ID NO: 197277
  derived and/or modified sequence opt5 from neuraminidase__InfluenzaA__AAZ83291

SEQ ID NO: 197400 - RNA, 1413 nt, Artificial Sequence
  derived and/or modified sequence opt5 from neuraminidase__InfluenzaA__AAZ83302
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaaggcgucugugacccuggcuggcaauagcucccuuuguagcauuucugggugggccaucuacacaaaagauaacuccauucggaucggaagcaagggcgacgucuucgugauucgcgaaccuuuuaucucuugcucccauagcgaguguagaaccuucuuucugacgcaaggcgcccuccugaaugauaaacacucuaacgggaccguuaaggaccgguccccguaucgcgcucuuaugagcugcccccugggagaagccccuucccccuacaauucuaaguucgagagcguggcuugguccgccagcgcgugucaugauggcaugggguggcucacaaucggaauuucuggcccugacaacggggccgucgcugugcugaaauauaacggaaucauuaccgaaacaaucaaguccuggaaaaagcagauucugagaacccaggagagcgagugcguuugugugaauggcucuugcuuuacgaucaugacagauggccccagcaacggggccgcuuccuacaaaaucuucaagauugaaaagggaaaagucaccaagucuaucgagcucaaugccccuaacuuucacuaugaagaguguagcugcuacccggacacaggcaccgugaugugugugugccgggauaauuggcacggguccaaccgccccugggucagcuucaaucagaaccuggacuaccaaauuggauauaucugcucuggcguuuuuggggauaauccuagacccaaagacggagagggcuccuguaacccugugaccguggauggcgcgaauggggucaagggauucagcuacaaauauggcaacgggguguggauuggacggacaaagucuaaucgccuuagaaaaggcuuugaaaugaucugggaccccaacggguggacggacaccgauuccgacuucagcguuaagcaggauguggucgccauuacagacugguccggcuacucuggauccuuugugcagcauccggagcugaccggccucgauugcauccggccuuguuucuggguugaacuggugcgcgggcuucccaaggagaauacaaccaucuggacguccggaucuagcauuuccuucugcggcgucaacagcgacacagcuaacuggucuuggccugauggggccgaacugcccuuuaccaucgacaaauga

SEQ ID NO: 197401 - RNA, 1410 nt, Artificial Sequence
  derived and/or modified sequence opt5 from neuraminidase__InfluenzaA__AAZ83315
augaaccccaaucagaagaucauuaccaucggcagcguuucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgauaagugcuaccaauucgcccucgggcagggaaccacacugaauaaccggcauucuaaugacaccguucacgaucgcacgccuuauagaacacugcucaugaacgaacugggcgugccguuucaucuugggaccaaacaggucuguaucgccuggagcuccagcucuugccacgacggaaaggcuuggcugcauguguguguuacaggccacgaugagaaugccaccgcuuccuucauuuacgacggccggcucguggauagcaucgggucuugguccaaaaagauucugcgcacccaggaaagcgagugcgucuguaucaacggaacaugcacgguggugaugaccgacggcucugccuccgggagagcgaauacaaaaauucuuuuuaucgaggaaggaaagaucauucacaucagccaacuguccggcucugcccagcaugucgaggaaugcagcuguuauccccgguacccugggguucgcugcguguguagagauaacuggaagggauccaaccggcccauuguggacaucaaugucaaagauuacagcauugcuucuuccuaugugugcagcggccucguuggcgacaccccucgcaagaacgacucuagcuccucuagccacugucugaaucccaacaaugaggaagggggacauggcgugaaagggugggccuucgaugacggaaacgaugucuggaugggcagaacaaucuccgagaaguuucggagcggguacgagaccuucaaagugaucgaaggauggucuaagccuaauuccaaacugcagauuaaccgccagguuaucguggacagagauaaucggagcggcuauucuggcauuuuuagcgucgaggggaaguccugcaucaacagauguuucuacguggaacucauucgcggacggaagcaagagacggaagucugguggacauccaauucuaucgugguguuuugcggcaccagcgggaccuauggaacaggcuccuggccggacggggcugauauuaaccugaugcccaucuga

SEQ ID NO: 197402 - RNA, 1410 nt, Artificial Sequence
  derived and/or modified sequence opt5 from neuraminidase__InfluenzaA__AAZ83326
augaaccccaaucagaagaucauuaccaucggcagcgugucccugacaauugccacgaucugcuuccucaugcaaauugcuauccuggucaccacaguuacccuucacuuuaaacaguacgagugugacucucugccuaacaaucaggugaugcucugcgaaccgacaaucauugagagaaacaucaccgaaauuguguaucugacaaauaccacgaucgagaaggaaauuugucccaaacuugccgaguaccggaacuggagcaagccucagugcaaaaucaccggguucgcgcccuuuuccaaggauaauucuauucgccugagcgcuggaggcgacaucugggucacaagagagccuuauguguccugugaucccgacaagugcuaccaauucgcccucgggcagggaaccacacugaacaaucggcauucuaacgauaccguucacgaccgcacgccuuauagaacacugcucaugaaugaacugggcgugccguuucaucuugggaccaaacaggucuguaucgccuggagcuccagcucuugccacgauggaaaggcuuggcugcauguguguguuacaggccacgacgagaacgccaccgcuuccuucauuuacgauggccggcucguggacagcaucgggucuugguccaaaaagauucugcgcacccaggaaagcgagugcgucuguaucaauggaacaugcacgguggugaugaccgauggcucugccuccgggagagcggacacaaaaauucuuuuuaucgaggaaggaaagaucauucacaucagccaacuguccggcucugcccagcaugucgaggaaugcagcuguuauccccgguacccugggguucgcugcguguguagagauaacuggaagggauccaaucggcccauuguggacaucaacgucaaagacuacagcauugugucuuccuauguuugcagcggccucgugggcgauaccccucgcaagaacgacucuagcuccucuagccacugucugaaucccaacaaugaggaagggggacauggcgucaaagggugggcuuucgaugacggaaacgauguguggaugggcagaacaaucuccgagaaguuucggagcggguacgagaccuucaaaguuaucgaaggauggucuaagccuaauuccaaacugcagauuaaccgccaggugaucgucgacagagauaaucggagcggcuauucuggcauuuuuagcguggaggggaaguccugcaucaacagauguuucuacgucgaacucauucgcggacggaagcaagagacggaagugugguggacauccaauucuaucguuguguuuugcggcaccagcgggaccuauggaacaggcuccuggccggacggggccgauauuaaccugaugcccaucuga

SEQ ID NO: 197403 - RNA, 1410 nt, Artificial Sequence
  derived and/or modified sequence opt5 from neuraminidase__InfluenzaA__AAZ83374
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcacaggcuacgagaccuuuaaagugaucgaaggguggucuaacccuaauuccaagcugcagauuaacagacaggucaucguggaucggggaaaucgcagcggcuauucuggcauuuucuccgucgaggggaaaagcuguaucaacagaugcuuuuacguggaacugauucggggaagaaaggaggaaaccgagguucucuggacauccaauucuaucguggucuucuguggcaccagcgggacauauggaacgggcuccuggcccgacggggcugauauuaaccugaugccuaucuga

SEQ ID NO: 197404 - RNA, 1410 nt, Artificial Sequence; identical to SEQ ID NO: 197370
  derived and/or modified sequence opt5 from neuraminidase__InfluenzaA__AAZ83385

SEQ ID NO: 197405 - RNA, 1413 nt, Artificial Sequence
  derived and/or modified sequence opt5 from neuraminidase__InfluenzaA__AAZ85129
augaacaccaaucagaagaucauuacaaucggcagcauuuccaucgccauugggaucaucucucugaugcuccaaauuggaaacaucauuagcaucugggcuucccacucuauucagacgggcagccagaaucauaccggggugugcaaccagagaaucauuacauacgaaaauuccaccugggucaaccacacauauguuaauaucaacaauaccaacgugaucgccggaaaagacaagacaucugugacccuggcgggcaauagcucccuuuguagcauuucugggugggcuaucuacacgaaagauaacuccauucggaucggaagcaagggcgacgucuucgugauucgcgagcccuuuaucucuugcucccaucuggaguguagaaccuucuuucucacacaaggcgcccugcuuaaugauaaacacagcaacgggaccguuaaggaccggucuccuuaucgcgcccugauguccugcccgcucggagaagcucccagcccuuacaauuccaaguucgagucuguggccuggagcgcuuccgccugucaugauggcaugggguggcugacaaucggaauuagcggccccgacaacggggcggucgccgugcugaaauauaacggaaucauuaccgaaacgaucaagucuuggaaaaagcagauucucagaacacaggaguccgagugcguuugugugaauggcagcugcuuuaccaucaugacagauggcccuucuaacggggcugccagcuacaaaaucuucaagauugaaaagggaaaagucaccaaguccaucgagcugaaugcucccaacuuucacuaugaagaguguucuugcuacccugacaccggcacagugaugugugugugccgggauaauuggcacgggagcaaccgcccgugggucuccuucaaucagaaccuugacuaccaaauuggauauaucugcagcggcguuuuuggggauaaucccagaccuaaagacggagagggcucuuguaaccccgugacgguggauggcgccaauggggucaagggauucuccuacaaauauggcaacgggguguggauuggacggaccaagagcaaucgccugagaaaaggcuuugaaaugaucugggacccuaacggguggacagacaccgauucugacuucuccguuaagcaggauguggucgcgauuacagacuggagcggcuacuccggaucuuuugugcagcaucccgagcucaccggccuggauugcauccggccguguuucuggguugaacuugugcgcgggcugccuaaggagaauacgacaaucuggaccagcggauccucuauuagcuucugcggcgucaacuccgacaccgccaacuggagcuggcccgauggggcugaacucccuuuuacaaucgacaaauga

SEQ ID NO: 197406 - RNA, 1410 nt, Artificial Sequence
  derived and/or modified sequence opt5 from neuraminidase__InfluenzaA__ABA06513
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucaacggcacgugcaccguggugaugacagacgggucugccuccggaaaagcggauaccaagauucuguuuaucgaggagggcaagaucguccacacaagccuucuguccgggucugcccaacacguugaagagugcagcuguuauccucgcuaccccggagugagaugcgugugucgggacaacuggaaaggcuccaaucgcccuauugucgauaucaacgugaaggacuacagcauuguuucuuccuaugugugcagcggccucgucggggacacccccagaaagaaugauucuagcuccucuagccauugucuggacccgaacaaugaagagggaggccacggggugaaaggaugggcuuucgaugacggcaacgauguuuggauggggcggacgaucuccgaaaaacugcgcagcggauacgagacauuuaaggugauugagggcuggucuaaaccuaauuccaagcuccagaucaacagacaggucaucguggaccgggauaaucgcagcggcuauucugggauuuucuccgucgaaggaaagagcugcaucaacagauguuuuuacguggagcugauucggggcagaaaucaggaaaccgagguucuuuggaccuccaacucuaucguggucuucugcgggacaagcggaaccuauggcacaggguccuggcccgacggcgccgauauuaaucugaugccuaucuga

SEQ ID NO: 197407 - RNA, 1410 nt, Artificial Sequence; identical to SEQ ID NO: 197406
  derived and/or modified sequence opt5 from neuraminidase__InfluenzaA__ABA06545

SEQ ID NO: 197408 - RNA, 1413 nt, Artificial Sequence
  derived and/or modified sequence opt5 from neuraminidase__InfluenzaA__ABA08478
augaacaccaaucagaagaucauuacaaucggcagcauuuccaucgccauugggaucaucucucugaugcuccaaauuggaaacaucauuagcaucugggcuucccacucuauucagacgggcagccagaaucauaccgggaucugcaaccagagaauuaucacauacgaaaauuccaccugggugaaccacacauaugucaauaucaacaauaccaacguuguggccggaaaagacaagacaucugugacccuggcgggcaauagcucccuuuguagcauuucugggugggcuaucuacacgaaagauaacuccauucggaucggaagcaagggcgacgucuucgugauucgcgagcccuuuaucucuugcucccaucuggaguguagaaccuucuuucucacacaaggcgcccugcuuaaugauaaacacagcaacgggaccguuaaggaccggucuccuuaucgcgcccugauguccugcccgcucggagaagcucccagcccuuacaauuccaaguucgagucuguggccuggagcgcuuccgccugucaugauggcaugggguggcugacaaucggaauuagcggccccgacaacggggcggucgccgugcugaaauauaacggaaucauuaccgaaacgaucaagucuuggaaaaagcggauucucagaacacaggaguccgagugcguuugugugaauggcagcugcuuuaccaucaugacagauggcccuucuaacggggcugccagcuacaaaaucuucaagauugaaaagggaaaagucaccaaguccaucgagcugaaugcucccaacuuucacuaugaagaguguucuugcuacccugacaccggcacagugaugugugugugccgcgauaauuggcacgggagcaacagaccgugggucuccuucaaucagaaccuugacuaccagauuggauauaucugcagcggcguuuuuggggauaauccccggccuaaagacggaaagggcucuuguaaccccgugacgguggauggcgccgacggggucaaaggauucuccuacaaguauggcaaugggguguggauuggacgcaccaaaagcaacagacugcggaagggcuuugagaugaucugggacccuaauggguggacagauaccgacucugauuucuccguuaagcaagacguggucgcgauuacagauuggagcggcuacuccggaucuuuugugcagcaucccgaacucaccggccuggacugcauccgcccguguuucuggguugagcuugugagagggcugccucgggaaaacacgacaaucuggaccagcggauccucuauuagcuucugcggcgucgauuccgacaccgccaauuggagcuggcccgauggggcugagcucccuuuuacaaucgacaaauga

SEQ ID NO: 197409 - RNA, 1410 nt, Artificial Sequence; identical to SEQ ID NO: 197406
  derived and/or modified sequence opt5 from neuraminidase__InfluenzaA__ABA08511

SEQ ID NO: 197410 - RNA, 1413 nt, Artificial Sequence
  derived and/or modified sequence opt5 from neuraminidase__InfluenzaA__ABA12699
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcgauuaccgauuggagcggcuacuccggaucuuuugugcagcauccggaacucacaggccuggacugcauccgcccuuguuucuggguugagcuugugagagggcugccccgggaaaacaccacgaucuggacaagcggauccucuauuagcuucugcggcgucgauuccgacaccgccaauuggagcuggccugauggggcugagcuccccuuuaccaucgacaaauga

SEQ ID NO: 197411 - RNA, 1413 nt, Artificial Sequence; identical to SEQ ID NO: 197410
  derived and/or modified sequence opt5 from neuraminidase__InfluenzaA__ABA12710

SEQ ID NO: 197412 - RNA, 1413 nt, Artificial Sequence
  derived and/or modified sequence opt5 from neuraminidase__InfluenzaA__ABA12721
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauuggaaagggcaaagucacaaaguccaucgaacugaaugcuccuaacuuucacuaugaggaauguucuugcuacccggacaccgggaccgugaugugugugugccgggauaauuggcacggaagcaaccgccccugggucuccuucaaucagaaccuugacuaccaaauuggcuauaucugcagcgggguuuuuggagauaauccuagaccccgggacggcgagggcucuuguaacccugugacaguggauggggccaauggagucaaaggcuucuccuacaaguaugggaacggaguguggauuggccgcacgaaaagcaauagacugcggaagggguuugagaugaucugggaccccaacggcuggaccgacacagauucugacuucuccguuaaacaggauguggucgcgauuaccgacuggagcggauacuccggcucuuuugugcagcauccggaacucacagggcuggauugcauccgcccuuguuucuggguugagcuugugagaggacugccccgggaaaauaccacgaucuggacaagcggcuccucuauuagcuucugcggggucaacuccgacaccgccaacuggagcuggccugauggagcugagcuccccuuuaccaucgacaaguga

SEQ ID NO: 197413 - RNA, 1413 nt, Artificial Sequence; identical to SEQ ID NO: 197410
  derived and/or modified sequence opt5 from neuraminidase__InfluenzaA__ABA12732

SEQ ID NO: 197414 - RNA, 1410 nt, Artificial Sequence; identical to SEQ ID NO: 197351
  derived and/or modified sequence opt5 from neuraminidase__InfluenzaA__ABA12743

SEQ ID NO: 197415 - RNA, 1410 nt, Artificial Sequence; identical to SEQ ID NO: 197367
  derived and/or modified sequence opt5 from neuraminidase__InfluenzaA__ABA12754

SEQ ID NO: 197416 - RNA, 1410 nt, Artificial Sequence; identical to SEQ ID NO: 197370
  derived and/or modified sequence opt5 from neuraminidase__InfluenzaA__ABA12765

SEQ ID NO: 197417 - RNA, 1410 nt, Artificial Sequence; identical to SEQ ID NO: 197142
  derived and/or modified sequence opt5 from neuraminidase__InfluenzaA__ABA12776

SEQ ID NO: 197418 - RNA, 1410 nt, Artificial Sequence; identical to SEQ ID NO: 197351
  derived and/or modified sequence opt5 from neuraminidase__InfluenzaA__ABA12786

SEQ ID NO: 197419 - RNA, 1410 nt, Artificial Sequence; identical to SEQ ID NO: 197370
  derived and/or modified sequence opt5 from neuraminidase__InfluenzaA__ABA18029

SEQ ID NO: 197420 - RNA, 1413 nt, Artificial Sequence
  derived and/or modified sequence opt5 from neuraminidase__InfluenzaA__ABA18040
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgggauaauuggcacgggagcaaccgccccugggucuccuucaaucagaaccuugacuaccaaauuggauauaucugcagcggcguuuuuggggauaauccuagacccaaagacggagagggcucuuguaacccugugacaguggauggcgccaauggggucaagggauucuccuacaaauauggcaacgggguguggauuggacggacgaaguccaaucgccugagaaaaggcuuugaaaugaucugggaccccaacggguggaccgacacagauucugacuucuccguuaagcaggauguggucgcgauuaccgacuggagcggcuacuccggaucuuuugugcagcauccggagcucacaggccuggauugcauccggccuuguuucuggguugaacuugugcgcgggcugcccaaggagaauaccacgaucuggacaagcggauccucuauuagcuucugcggcgucaacuccgacaccgccaacuggagcuggccugauggggcugaacuccccuuuaccaucgacaaauga

SEQ ID NO: 197421 - RNA, 1410 nt, Artificial Sequence
  derived and/or modified sequence opt5 from neuraminidase__InfluenzaA__ABA18126
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacacccagaaagaaugauucuuucagcuccucucauugucucgacccgaacaaugaggaaggaggccacggggugaaaggaugggcuuuugaugacggcaacgauauguggauggggcggaccauuagcgagaagcugcgcuccggauacgagacguucaaaguuaucgaaggcuggagcaagccuaauucuaaacugcagaucaacagacaggugauugucgagcggggcaaucgcuccggguauagcggaaucuuuucuguggaaggcaaguccugcauuaacagauguuucuacgucgagcucauccgggggagaaaggaagagacagaggugugguggaccagcaauuccauuguuguguuuugcggaaccucuggcacauaugggaccggcagcuggcccgacggagccgauaucaaccugaugccuauuuga

SEQ ID NO: 197422 - RNA, 1413 nt, Artificial Sequence; identical to SEQ ID NO: 197410
  derived and/or modified sequence opt5 from neuraminidase__InfluenzaA__ABA18148

SEQ ID NO: 197423 - RNA, 1410 nt, Artificial Sequence
  derived and/or modified sequence opt5 from neuraminidase__InfluenzaA__ABA18159
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacaugugcuguggucaugacggauggauccgccagcggcaaggcggacaccaaaauccucuuuaucgaggaagggaagauuguucacacauccaagcugucuggaagcgcccaacacguggaggaaugcuccugcuauccucgcuaccccggcaucagaugugugugccgggauaacuggaaagggagcaaccgcccuauugucgacgugaauaucaaggacuacucuauuguuuccagcuauguguguucuggacuugucggcgauacccccagaaagaacgacagcuccucuagcucccauugccuggauccgaauaacgaggaaggcgggcacggagugaaaggcugggcuuucgacgaugggaaugacguuuggaugggacggacaaucagcgagaaacuccgcucuggcuacgagaccuuuaaggugaucgaagggugguccaacccuaauagcaaacugcagauuaacagacaggucaucguggaucggggaaaucgcucuggcuauuccggcauuuucagcgucgaggggaaguccuguaucaacagaugcuuuuacguggaacugauucggggaagaaaggaggaaacggagguucucuggacaucuaauagcaucguggucuucuguggcaccuccgggaccuauggaacaggcucuuggcccgacggggccgauauuaaccugaugccuaucuga

SEQ ID NO: 197424 - RNA, 1410 nt, Artificial Sequence; identical to SEQ ID NO: 197351
  derived and/or modified sequence opt5 from neuraminidase__InfluenzaA__ABA26703

SEQ ID NO: 197425 - RNA, 1410 nt, Artificial Sequence; identical to SEQ ID NO: 197351
  derived and/or modified sequence opt5 from neuraminidase__InfluenzaA__ABA26714

SEQ ID NO: 197426 - RNA, 1410 nt, Artificial Sequence; identical to SEQ ID NO: 197351
  derived and/or modified sequence opt5 from neuraminidase__InfluenzaA__ABA26736

SEQ ID NO: 197427 - RNA, 1410 nt, Artificial Sequence; identical to SEQ ID NO: 197351
  derived and/or modified sequence opt5 from neuraminidase__InfluenzaA__ABA26747

SEQ ID NO: 197428 - RNA, 1410 nt, Artificial Sequence; identical to SEQ ID NO: 197351
  derived and/or modified sequence opt5 from neuraminidase__InfluenzaA__ABA26758

SEQ ID NO: 197429 - RNA, 1410 nt, Artificial Sequence; identical to SEQ ID NO: 197351
  derived and/or modified sequence opt5 from neuraminidase__InfluenzaA__ABA26769

SEQ ID NO: 197430 - RNA, 1410 nt, Artificial Sequence; identical to SEQ ID NO: 197351
  derived and/or modified sequence opt5 from neuraminidase__InfluenzaA__ABA26780

SEQ ID NO: 197431 - RNA, 1410 nt, Artificial Sequence; identical to SEQ ID NO: 197351
  derived and/or modified sequence opt5 from neuraminidase__InfluenzaA__ABA26791

SEQ ID NO: 197432 - RNA, 1410 nt, Artificial Sequence; identical to SEQ ID NO: 197351
  derived and/or modified sequence opt5 from neuraminidase__InfluenzaA__ABA26802

SEQ ID NO: 197433 - RNA, 1413 nt, Artificial Sequence
  derived and/or modified sequence opt5 from neuraminidase__InfluenzaA__ABA42250
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcgacgggguguggauuggacgcacgaaaagcaauagacugcggaagggcuuugagaugaucugggaucccaacggguggaccgacacagauucugacuucuccguuaagcaagauguggucgcgauuaccgacuggagcggcuacuccggaucuuuugugcagcauccggaacucacaggccuggauugcauccgcccuuguuucuggguugagcuugugagagggcugccccgggaaaauaccacgaucuggacaagcggauccucuauuagcuucugcggcgucgacuccgauaccgccaacuggagcuggccugacggggcugagcuccccuuuaccaucgauaaauga

SEQ ID NO: 197434 - RNA, 1413 nt, Artificial Sequence; identical to SEQ ID NO: 197420
  derived and/or modified sequence opt5 from neuraminidase__InfluenzaA__ABA42261

SEQ ID NO: 197435 - RNA, 1410 nt, Artificial Sequence
  derived and/or modified sequence opt5 from neuraminidase__InfluenzaA__ABA42272
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaaugugugugcauuaaugggacauguacgguggucaugaccgacggauccgcuagcggcaaggccgauacaaaaauccucuuuaucgaggaggggaagauuguucacaccuccacacugucuggaagcgcgcaacacguggaagagugcuccugcuauccucgcuaccccggcgugagaugugucugccgggacaacuggaaggggagcaaccgcccuaucguggacauuaauaucaaagauuacucuauuguuuccagcuauguguguucuggacuugucggcgacacccccagaaagaacgauagcuccucuagcucccauugccuggacccgaauaacgaagagggcgggcacggagugaaaggcugggccuucgaugacgggaaugauguuuggaugggacggacgaucaacgaaaagcuccgccugggcuacgagacauuuaaagugaucgagggguggagcaauccuaacucuaagcugcagauuaauagacaggucaucguggaacggggaaaccgcuccggcuauagcggcauuuucucugucgaggggaaauccuguaucaauagaugcuuuuacguggaacucauucggggaagaaaggaggaaaccgagguucuguggaccagcaacuccaucguggucuucuguggcacaucugggaccuauggaacaggcagcuggcccgacggggcugauauuaaucuuaugccuaucuga

SEQ ID NO: 197436 - RNA, 1410 nt, Artificial Sequence; identical to SEQ ID NO: 197351
  derived and/or modified sequence opt5 from neuraminidase__InfluenzaA__ABA42294

SEQ ID NO: 197437 - RNA, 1410 nt, Artificial Sequence; identical to SEQ ID NO: 197178
  derived and/or modified sequence opt5 from neuraminidase__InfluenzaA__ABA42305

SEQ ID NO: 197438 - RNA, 1410 nt, Artificial Sequence; identical to SEQ ID NO: 197188
  derived and/or modified sequence opt5 from neuraminidase__InfluenzaA__ABA42316

SEQ ID NO: 197439 - RNA, 1413 nt, Artificial Sequence
  derived and/or modified sequence opt5 from neuraminidase__InfluenzaA__ABA42327
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucugauuucuccguuaagcaagacguggucgcgauuaccgauuggagcggcuacuccggaucuuuugugcagcauccggagcucacaggccuggacugcauccgcccuuguuucuggguugaacuugugagagggcugccccgggagaacaccacgaucuggacaagcggauccucuauuagcuucugcggcgucaauuccgauaccgccaacuggagcuggccugacggggcugaacuccccuuuaccaucgauaaguga

SEQ ID NO: 197440 - RNA, 1410 nt, Artificial Sequence; identical to SEQ ID NO: 197173
  derived and/or modified sequence opt5 from neuraminidase__InfluenzaA__ABA42338

SEQ ID NO: 197441 - RNA, 1410 nt, Artificial Sequence
  derived and/or modified sequence opt5 from neuraminidase__InfluenzaA__ABA42349
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcugugcgaacccacaaucauugagagaaacaucaccgaaauuguguaucucacaaauaccacgaucgagaaggaaauuuguccuaaacuggccgaguaccggaacuggagcaagccccagugcaauaucaccggguucgcgccuuuuuccaaagauaacucuauucgccuuagcgcuggaggcgacaucugggucacaagagagcccuauguguccugugauccugacaagugcuaccaauucgcccuggggcagggaaccacacucaauaacggccauucuaaugauaccguucacgaccggacgccguaucgcacacugcugaugaacgaacucggggugcccuuucaucugggaaccagacaggucuguaucgccuggagcuccagcucuugccacgauggcaaggcuuggcuucauguguguguuacaggcgacgaugagaaugccaccgcuuccuucauuuacaacgggaaacugguggacagcaucggaucuugguccaagaaaauucuccggacccaggaaagcgagugcgucuguaucaauggcacaugcacgguggugaugaccgaugggucugccuccggaaaggcggacacaaaaauucuguuuaucgaggaaggcaagaucguccacauuagcacccuuuccgggucugcccaacacguugaggaaugcagcuguuauccucgcuaccccggagugagaugcgugugucgggauaacuggaagggcuccaaccgcccuaucgucgacauuaaugugaaagacuacagcaucguuucuuccuaugugugcagcggccuggucggggauacacccagaaagaacgacucuuucagcuccucucauugucucgauccgaauaacgaggaaggaggccacggggugaaaggaugggcuuuugacgauggcaaugacguuuggauggggcggaccauuagcgagaagcugcgcuccggauacgagacguucaaagugaucgaaggcuggagcaagccuaacucuaaacugcagaucaauagacaggucauuguggagcggggcaaccgcuccggguauagcggaaucuuuucugucgaaggcaaguccugcauuaauagauguuucuacguggagcucauccgggggagaaaggaagagacagagguuugguggaccagcaacuccauuguggucuuuugcggaaccucuggcacauaugggaccggcagcuggcccgauggagccgacaucaaucugaugccuauuuga

SEQ ID NO: 197442 - RNA, 1410 nt, Artificial Sequence; identical to SEQ ID NO: 197178
  derived and/or modified sequence opt5 from neuraminidase__InfluenzaA__ABA42360

SEQ ID NO: 197443 - RNA, 1410 nt, Artificial Sequence; identical to SEQ ID NO: 197173
  derived and/or modified sequence opt5 from neuraminidase__InfluenzaA__ABA42371

SEQ ID NO: 197444 - RNA, 1410 nt, Artificial Sequence; identical to SEQ ID NO: 197188
  derived and/or modified sequence opt5 from neuraminidase__InfluenzaA__ABA42382

SEQ ID NO: 197445 - RNA, 1410 nt, Artificial Sequence; identical to SEQ ID NO: 197173
  derived and/or modified sequence opt5 from neuraminidase__InfluenzaA__ABA42393

SEQ ID NO: 197446 - RNA, 1410 nt, Artificial Sequence
  derived and/or modified sequence opt5 from neuraminidase__InfluenzaA__ABA42404
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucgucaacauuagcacacuuccuggguccgcucaacacguugaggaaugcucuuguuaucccagauacccuggagugcggugcgugugucgcgacaauuggaagggcagcaacagacccaucgucgauauuaaugugaaggacuacuccaucguuagcucuuaugugugcuccggccuggucggggacaccccgcggaaaaacgauagcuucucuagcucccacugucucgacccuaauaacgaggaaggaggccauggggugaagggaugggccuuugaugacggcaaugauguuuggauggggcgcacaauuucugagaaacugagaagcggauacgagaccuucaaggugaucgaaggcugguccaaacccaacagcaagcugcagaucaaucggcaggucauuguggagcgcggcaacagaucuggguauuccggaaucuuuagcgucgaaggcaaaucuugcauuaaucgguguuucuacguggagcucaucagagggcgcaaggaagagacggagguuugguggacauccaacagcauuguggucuuuugcggaaccuccggcaccuaugggacaggcucuuggccugacggagcugauaucaaucugaugcccauuuga

SEQ ID NO: 197447 - RNA, 1410 nt, Artificial Sequence; identical to SEQ ID NO: 197188
  derived and/or modified sequence opt5 from neuraminidase__InfluenzaA__ABA42415

SEQ ID NO: 197448 - RNA, 1410 nt, Artificial Sequence; identical to SEQ ID NO: 197195
  derived and/or modified sequence opt5 from neuraminidase__InfluenzaA__ABA42446

SEQ ID NO: 197449 - RNA, 1410 nt, Artificial Sequence
  derived and/or modified sequence opt5 from neuraminidase__InfluenzaA__ABA42457
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagaucaaccggcaggucauuguggagcgcggcaauagauccggguauagcggaaucuuuucugucgaauccaaaagcugcauuaaccgguguuucuacguggagcucaucagaggccgcaaggaagagacagagguuugguggaccuccaauucuauuguggucuuuugcgggaccagcggaacauauggcaccggguccuggcccgacggcgccgauaucaaccugaugccuauuuga

SEQ ID NO: 197450 - RNA, 1410 nt, Artificial Sequence; identical to SEQ ID NO: 197195
  derived and/or modified sequence opt5 from neuraminidase__InfluenzaA__ABA42468

SEQ ID NO: 197451 - RNA, 1410 nt, Artificial Sequence
  derived and/or modified sequence opt5 from neuraminidase__InfluenzaA__ABA42479
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcugugcgaacccacaaucauugagagaaacaucaccgaaauuguguaucucacaaauaccacgaucgagaaggaaauuuguccuaaacuggccgaguaccggaacuggagcaagccccagugcaauaucaccggguucgcgccuuuuuccaaagauaacucuauucgccuuagcgcuggaggcgacaucugggucacaagagagcccuauguguccugugauccugacaagugcuaccaauucgcccuggggcagggaaccacacucaauaacggccauucuaaugauaccguucacgaccggacgccguaucgcacacugcugaugaacgaacucggggugcccuuucaucugggaaccagacaggucuguaucgccuggagcuccagcucuugccacgauggcaaggcuuggcuucauguguguguuacaggcgacgaugagaaugccaccgcuuccuucauuuacaacgggcggcugguggacagcaucggaucuugguccaaaaagauucuccgcacccaggaaagcgagugcgucuguaucaauggcacaugcacgguggugaugaccgaugggucugccuccggaaaagcggacacaaagauucuguuuaucgaggaaggcaaaaucguccacauuagcacccuuuccgggucugcccaacacguugaggaaugcagcuguuauccuagauaccccggagugcggugcgugugucgcgauaacuggaagggcuccaacagaccuaucgucgacauuaaugugaaggacuacagcaucguuucuuccuaugugugcagcggccuggucggggauacaccccggaaaaacgacucuuucagcuccucucauugucucgauccgaauaacgaggacggaggccacggggugaagggaugggcuuuugaugacggcaaugauguuuggauggggcgcaccauuagcgaaaaacugagauccggauacgagacguucaaggugaucgagggcuggagcaaaccuaacucuaagcugcagaucaaucggcaggucauuguggaacgcggcaacagauccggguauagcggaaucuuuucugucgagggcaaauccugcauuaaucgguguuucuacguggaacucaucagagggcgcaaggaggaaacagagguuugguggaccagcaacuccauuguggucuuuugcggaaccucuggcacauaugggaccggcagcuggcccgacggagccgauaucaaucugaugccuauuuga

SEQ ID NO: 197452 - RNA, 1410 nt, Artificial Sequence
  derived and/or modified sequence opt5 from neuraminidase__InfluenzaA__ABA42490
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcaaacuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaagaaugauucuuucagcuccucucauugucucgacccgaacaaugaggaaggaggccacggggugaaaggaugggcuuuugaugacggcaacgauguuuggauggggcgcaccauuagcgagaagcugagauccggauacgagaccuucaaagugaucaagggcuggagcaaaccuaauucuaagcugcagaucaaccggcaggucauuguggaacgcggcaauagauccggguauagcggaaucuuuucugucgagggcaaguccugcauuaaccgguguuucuacguggaacucaucagagggcgcaaagaggaaacggagguuugguggacaagcaauuccauuguggucuuuugcggaaccucuggcaccuaugggacaggcagcuggcccgacggagccgauaucaaccugaugccuauuuga

SEQ ID NO: 197453 - RNA, 1410 nt, Artificial Sequence; identical to SEQ ID NO: 197195
  derived and/or modified sequence opt5 from neuraminidase__InfluenzaA__ABA42501

SEQ ID NO: 197454 - RNA, 1410 nt, Artificial Sequence
  derived and/or modified sequence opt5 from neuraminidase__InfluenzaA__ABA42512
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguauccuacaaacaccacgaucgagaaggaaauuugucccaaacucgccgaguaccggaauuggagcaagccucagugcaacaucaccggguucgcgcccuuuuccaaagacaauucuauucgccugagcgcuggaggcgauaucugggucacaagagagccuuauguguccugugacccggauaagugcuaccaauucgcccuugggcagggaaccacacugaacaauggccauucuaacgacaccguucacgaucggacgcccuaucgcacacuccugaugaaugaacugggggugccuuuucaucucggaaccaagcaggucuguaucgccuggagcuccagcucuugccacgacggcaaagccuggcugcauguguguguuacaggcgaugacgagaacgcuaccgcuuccuucauuuacaaugggagacuuguggauagcaucggaucuugguccaagaaaauucugcggacccaggaaagcgagugcgucuguaucaacggcacaugcacgguggugaugaccgacgggucugccuccggaaaggcggauacaaaaauucucuuuaucgaggaaggcaagaucguccacaccagcucccugucugggagcgcccaacacguugaggaaugcuccuguuauccccgcuacccuggagugagaugcgugugucgggacaacuggaagggcagcaaucgccccauugucgauaucaacgugaaagacuacucuauuguuuccagcuaugugugcucuggccuugucggggacacaccgagaaagaaugauagcuccucuagcucccauugucuggacccuaacaaugaggaaggaggccacggggugaaaggaugggcuuucgaugacggcaacgauguuuggauggggcggaccaucagcgagaagcuccgcucuggauacgagacguuuaaagugauugaaggcugguccaagcccaauagcaaacugcagaucaacagacaggucaucguggaccggggcaaucgcucuggguauuccggaauuuucagcgucgagggcaaguccugcaucaacagauguuuuuacguggaacugauucgggggagaaagcaggagacagaaguucucuggaccucuaauagcaucguggucuucugcggaaccuccggcacauaugggaccggcucuuggccugauggagccgacauuaaccugaugcccaucuga

SEQ ID NO: 197455 - RNA, 1410 nt, Artificial Sequence; identical to SEQ ID NO: 197085
  derived and/or modified sequence opt5 from neuraminidase__InfluenzaA__ABA42523

SEQ ID NO: 197456 - RNA, 1410 nt, Artificial Sequence; identical to SEQ ID NO: 197085
  derived and/or modified sequence opt5 from neuraminidase__InfluenzaA__ABA42534

SEQ ID NO: 197457 - RNA, 1410 nt, Artificial Sequence; identical to SEQ ID NO: 197277
  derived and/or modified sequence opt5 from neuraminidase__InfluenzaA__ABA42545

SEQ ID NO: 197458 - RNA, 1410 nt, Artificial Sequence
  derived and/or modified sequence opt5 from neuraminidase__InfluenzaA__ABA42556
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccggggcaaucgcagcggguauucuggaauuuucuccgucgagggcaagagcugcaucaacagauguuuuuacguggaacugauucgggggagaaagcaggaggccgaaguucuuuggacauccaauucuaucguggucuucugcggaaccagcggcaccuaugggacaggcuccuggcccgauggagcugacauuaaccugaugccuaucuga

SEQ ID NO: 197459 - RNA, 1410 nt, Artificial Sequence; identical to SEQ ID NO: 197085
  derived and/or modified sequence opt5 from neuraminidase__InfluenzaA__ABA42567

SEQ ID NO: 197460 - RNA, 1410 nt, Artificial Sequence
  derived and/or modified sequence opt5 from neuraminidase__InfluenzaA__ABA42931
augaaccccaaucagaagaucauuaccaucggcagcgugucccugacaauugccacgaucugcucucucaugcaaauugcuauccuggucaccacaguuacccuucacuucaaacaguacgaguguaacagcccuccgaauaaccaggugaugcugugcgaacccacaaucauugagagaaauaucaccgaaauuguguaucucacaaacaccacgaucgagaaggaaauuuguccuaaacuggccgaguaccggaauugguccaagccccagugcaacaucaccggguuugcgccuuucucuaaagacaauagcauucgccuuuccgcuggaggcgauaucugggucacaagagagcccuaugugucuugugacccugauaagugcuaccaauuugcccuggggcagggaaccacacucaacaauggccauagcaacgacaccguucacgaucggacgccguaucgcacacugcugaugaaugaacucggggugcccuuccaucugggaaccaagcaggucuguaucgccugguccucuagcuccugccacgacggcaaagccuggcuucauguguguguuacaggcgaugacgagaacgcuaccgcuagcuuuauuuacaaugggagacugguggauucuaucggauccuggagcaagaaaauucuccggacccaggaaucugagugcgucuguaucaacggcacaugcacgguggugaugaccgacggguccgccagcggaaaggcggauacaaaaauucuguucaucgaggaaggcaagaucguccacaccucccuucugucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccucgucggggacacacccagaaagaaugauagcuccucuagcucccauugucuggacccgaacaaugaggaaggaggccacggggugaaaggaugggcuuuugaugacggcaacgauguuuggauggggcggaccaucagcgagaagcugcgcucuggauacgagacguucaaagugauugaaggcugguccaagccuaauagcaaacuccagaucaacagacaggucaucguggaccggggcaaucgcucuggguauuccggaauuuuuagcgucgagggcaaguccugcaucaacagauguuucuacguggaacugauucgggggagaaagcaggagacagaaguucuuuggaccucuaauagcaucguggucuuuugcggaaccuccggcacauaugggaccggcucuuggcccgauggagccgacauuaaccugaugccuaucuga

SEQ ID NO: 197461 - RNA, 1410 nt, Artificial Sequence; identical to SEQ ID NO: 197085
  derived and/or modified sequence opt5 from neuraminidase__InfluenzaA__ABA42942

SEQ ID NO: 197462 - RNA, 1410 nt, Artificial Sequence; identical to SEQ ID NO: 197085
  derived and/or modified sequence opt5 from neuraminidase__InfluenzaA__ABA42981

SEQ ID NO: 197463 - RNA, 1410 nt, Artificial Sequence; identical to SEQ ID NO: 197173
  derived and/or modified sequence opt5 from neuraminidase__InfluenzaA__ABA42992

SEQ ID NO: 197464 - RNA, 1413 nt, Artificial Sequence
  derived and/or modified sequence opt5 from neuraminidase__InfluenzaA__ABA43192
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugauucuggcgggcaauagcucccuuuguagcaucucugggugggcuauuuacacaaaagauaacuccauccggauuggaagcaagggcgacgucuucgugauccgcgaaccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagcagauccucagaacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugaccguggauggcgccaauggggucaagggauucuccuacaaauauggcaacgggguguggaucggacggacaaagagcaaucgccugagaaaaggcuuugaaaugauuugggaccccaacggguggacggacaccgauucugacuucuccguuaagcaggauguggucagcaucacagacugguccggcuacucuggauccuuugugcagcauccggagcucaccggccuggauugcauccggccuuguuucuggguugaacuugugcgcgggcugcccaaggagaauacaaccauuuggacguccggaucuagcaucuccuucugcggcgucaacagcgacacagcgaacuggucuuggccugauggggccgaacuccccuuuaccauugacaaauga

SEQ ID NO: 197465 - RNA, 1410 nt, Artificial Sequence; identical to SEQ ID NO: 197370
  derived and/or modified sequence opt5 from neuraminidase__InfluenzaA__ABA43203

SEQ ID NO: 197466 - RNA, 1410 nt, Artificial Sequence
  derived and/or modified sequence opt5 from neuraminidase__InfluenzaA__ABA43339
augaaccccaaucagaagaucauuaccaucggcagcgugucccugucuauugccacaaucugcuuccucaugcaaauugcuauccuggucacgaccguuacacuucacuuuaaacaguacgaguguagcuccccuccgaacaaucaggugaugcccugcgaaccuaccaucauugagagaaacaucacagaaauuguguaucugaccaauacaaccaucgagaaggaaauuugucccaaacucgucgaguaccggaacuggucuaagccucagugcaaaaucacgggguucgcccccuuuagcaaggacaauuccauucgccugucugcgggaggcgauaucugggugaccagagagccuuauguuagcugugacccggggaagugcuaccaauucgcucuuggacagggcacaacccugaacaaucggcauuccaacgauacagugcacgaccgcacccccuauagaacgcuccugaugaaugaacugggggucccuuuucaucucggaacaaaacagguguguauggccuggucuagcuccagcugccacgauggcaaggccuggcugcauguuugugugaccggccacgacgagaacgcuacagccucuuucaucuacgaugggcggcuugucgacuccauuggaagcuggucuaaaaauauccugcgcacccaggaauccgagugcguguguauuaacgggaccugcacaguggucaugacggauggcagcgcuuccgagagagccgacaccaagauccucuuuauugaagagggaaaaaucguucacaucucuccccugagcggcuccgcgcaacauguggaagagugcagcuguuauccucgguaccccggggugcgcugcgucuguagagauaauuggaagggaucuaaccggccgauuguggacaucaacguuaaggauuacuccauugugagcucuuaugucugcagcggccuugugggcgacacaccucgcaaaaaugacagauccucuagcuccuacugucggaaccccaauaacgaaaaggggagccacggaguuaaaggcugggccuucgaugacgggaaugauguguggaugggacgcaccaucggcgaggagcugagaucuggguaugaaacauuuaaggucauuggaggcugguccaccccuaacagcaaacuccagaucaauagacaggugaucgucgacucuggcaaccgguccggguacagcggaauuuucuccguggagggcaagucuugcaucaaucgcuguuuuuauguugaacugauucgggggagaaaacaggagacgcgcgugugguggacaagcaacuccaucgucguguucugcggaaccucuggcaccuacgggacaggcagcuggcccgauggagcugacauuaaucugaugcccaucuga

SEQ ID NO: 197467 - RNA, 1410 nt, Artificial Sequence
  derived and/or modified sequence opt5 from neuraminidase__InfluenzaA__ABA54916
augaaccccaaucagaagaucauuaccacaggcagcaucugcauggugauugggauggucucccugaugcuccaaaucggaaacauuaucucuaucuggguuagccacuccauucagacgggcacccagcauagagccgagccuuguaaucggucuaucauuaacuacgaaaauaacacaugggugaaucagaccuaugugaaaaucagcaacacaaauuuccugaccgagaaggcugucgccuccgugcgccuuguugggaacucuagccugugcccgauuuccggaugggcgguguacagcaaagacaauucuaucagaauuggcuccaagggggaugucuuugugauccgggaacccuucaucagcuguucucaccucgagugccgcacauuuuuccugacccaaggagcccuucugaacgacaaacauuccaauggcacgguuaaggauagaagcccuuaucggacccucaugucuugucccgugggcgaagcuccuucccccuacaacagccgcuuugaguccgucgccuggucugcuagcgccugccacgacgggacauccuggcugaccauuggaaucagcggcccugauaauggggcuguggccgugcugaaguauaacggaauuaucacagacaccauuaaaucuuggagaaacaauauccuccgggcgcaggaguccgaaugugccugcgucaacggcagcuguuucacgguuaugacagaugggccgucuaauggacaggcuagcuacaagaucuuuaaaauugagaagggcaaaguggugaaguccgucgaacugaacgcccccaauuaucauuacgaggagugcucuuguuacccugacgcuggcgaaauuaccugcgugugccgcgauaacuggcacgggagcaauagacccuggguuuccuucaaccagaaucuugaguaucaaaucggauacaucuguagcggcguguuuggggacaacccucggcccaaugauggaacaggcucuugcgggccggucuccccuaacggagccuauggcgugaagggcuucagcuuuaaauacgggaauggaguuuggauuggccgcaccaagucuaccaacuccagaagcggguucgaaaugaucugggaccccaauggauggacaggcacggauuccaacuuuucugugaaacaggacaucgucgcgauuaccgacuggagcggguauuccggcucuuucgugcagcacccugagcugacaggacucgauuguauccggcccugcuucugggucgaacugauucgcggcagacccaaggagagcaccaucuggacauccgggagcucuauuuccuuuuguggagugaacagcgacaccguuggcuggucuuggccugauggggccgagcuuccguucacgaucgacaaauga

SEQ ID NO: 197468 - RNA, 1413 nt, Artificial Sequence
  derived and/or modified sequence opt5 from neuraminidase__InfluenzaA__ABA87048
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaaccgggcugccagcuacaaaaucuucaagauugaaaaggggaaagucacaaaguccguggagcugaaugcuccuaacuuucacuaugaagaguguucuugcuacccggacaccggaaccgugaugugugucugccgcgauaauuggcacggcagcaacagacccuggguuuccuucaaucagaaccuugacuaccaaaucggguauauuugcagcggaguguuuggcgauaauccucggcccaaagacggggagggaucuuguaacccugugacagucgauggcgccaauggcgugaagggguucuccuacaaauauggaaacggcguuuggaucgggcgcacgaaguccaauagacugcggaaaggauuugaaaugauuugggaccccaacggcuggaccgacacagauucugacuucuccgugaagcaggaugucguggcgaucaccgacuggagcggguacuccggcucuuuuguucagcauccggagcucacaggacuggauugcauucgcccuuguuucuggguggaacuugucagaggccugcccaaggagaauaccacgaucuggacaagcggguccucuaucagcuucugcggagugaacuccgacaccgccaacuggagcuggccugauggcgcugaacuccccuuuaccauugacaaauga

SEQ ID NO: 197469 - RNA, 1413 nt, Artificial Sequence
  derived and/or modified sequence opt5 from neuraminidase__InfluenzaA__ABA87060
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacgggacagcuagcuacaaaaucuucaagauugaaaagggaaaagucaccaaguccaucgagcugaaugccccuaacuuucacuaugaagaguguucuugcuacccggacaccggcacagugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguuccccugugacgguggauggcgcugacggggucaaaggauucagcuacaaguauggcaacgggguguggauuggacgcaccaaaucuaauagacugcggaagggcuuugagaugaucugggaccccaacggguggacagauaccgacuccgauuucagcguuaagcaagacguggucgccauuacagauugguccggcuacucuggauccuuugugcagcauccggaacucaccggccuggacugcauccgcccuuguuucuggguugagcuugugagagggcugccccgggaaaauacgacaaucuggaccuccggaucuagcauuuccuucugcggcgucgauagcgacaccgcgaacuggucuuggccugauggggccgagcuccccuuuacaaucgacaaauga

SEQ ID NO: 197470 - RNA, 1413 nt, Artificial Sequence
  derived and/or modified sequence opt5 from neuraminidase__InfluenzaA__ABA87083
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagaaaauuaucaccuacaagaauagcacaugggugaaccacaccuaugugaauaucaacaauacaaacguuguggccggaaaagacaagaccucugugacacuggcgggcaauagcucccuuuguagcauuucugggugggcuaucuacaccaaagauaacuccauuagaaucggaagcaagggcgacgucuucgugauucgggagccuuuuaucucuugcucccaucuggaaugucgcacguucuuucucacccaaggcgcccugcuuaaugauaagcacagcaacgggacaguuaaagacagaucuccguaucgggcccugauguccugcccccucggagaggcuccuagccccuacaauuccaaguucgaaucuguggccuggagcgcuuccgccugucaugauggcaugggguggcugaccaucggaauuagcggcccugacaacggggcggucgccgugcugaaauauaacggaaucauuacagagaccaucaagucuuggaaaaagcgcauucucagaacgcaggaauccgagugcguuugugugaauggcagcugcuuuacaaucaugaccgauggccccucuaacggggcugccagcuacaagaucuucaaaauugagaagggaaaagucacaaaguccaucgaacugaaugcuccuaacuuucacuaugaggaauguucuugcuacccggacaccggcaccgugaugugugugugccgggauaauuggcacgggagcaaccgccccugggucuccuucaaucagaaccuugacuaccagauuggauauaucugcagcggcguuuuuggggauaauccuagacccaaagacggagagggcucuuguaacccugugacaguggauggcgccgacggggucaagggauucuccuacaaauauggcaaugggguguggauuggacggacgaaguccaaccgccugagaaagggcuuugagaugaucugggaccccaauggguggaccgauacagacucuguuuucuccgugaaacaagaugucguggcgauuaccgacuggagcggcuacuccggaucuuuuguucagcauccggaacucacaggccuggauugcauccggccuuguuucuggguggagcuuguccgcgggcugcccagagaaaacaccacgaucuggacaagcggauccucuauuagcuucugcggcgucaauuccgacaccgccaacuggagcuggccugauggggcugagcuccccuuuaccaucgacaaguga

SEQ ID NO: 197471 - RNA, 1413 nt, Artificial Sequence
  derived and/or modified sequence opt5 from neuraminidase__InfluenzaA__ABA87234
augaacagcaaucagaagaucauuaccaucggcuccauuucuaucgccauugggaucaucagccugaugcuccaaauuggaaacaucauuuccaucugggcuucucacagcauucagacaggcucccagaaucauacgggggugugcaaccagagaaucauuaccuacgagaauagcacaugggucaaccacaccuauguuaauaucaacaauacaaacgugaucgccggaaaagacaagaccagcgugacacuggcgggcaauuccagccuuuguucuauuuccgggugggcuaucuacaccaaagauaacagcauucggaucggaucuaagggcgacgucuucgugauucgcgaacccuuuaucuccugcagccaucuggaguguagaacguucuuucucacccaaggcgcccugcuuaaugauaaacacucuaacgggacaguuaaggaccgguccccuuaucgcgcccugaugagcugcccgcucggagaagcucccuccccuuacaauucuaaguucgagagcguggccugguccgcuagcgccugucaugauggcaugggguggcugaccaucggaauuucuggccccgacaacggggcggucgccgugcugaaauauaacggaaucauuacagaaaccaucaaguccuggaaaaagcagauucucagaacgcaggagagcgagugcguuugugugaauggcucuugcuuuacaaucaugaccgauggcccuagcaacggggcugccuccuacaaaaucuucaagauugaaaagggaaaagucaucaagucuauugagcugaaugcucccaacuuucacuaugaagaguguagcugcuacccugacacaggcaccgugaugugugugugccgggauaauuggcacggguccaaccgcccgugggucagcuucaaucagaaccuugacuaccaaaucggauauauuugcucuggcguuuuuggggauaaucccagaccuaaagacggagagggcuccuguaaccccgugaccguggauggcgccaauggggucaagggauucagcuacaaauauggcaacgggguguggaucggacggacaaagucuaaucgccugagaaaaggcuuugaaaugauuugggacccuaacggguggacggacaccgauuccgacuucagcguuaagcaggauguggucgcgaucacagacugguccggcuacucuggaucuuuugugcagcaucccgagcucaccggccuggauugcauccggccguguuucuggguugaacuugugcgcgggcugccuaaggagaauacaaccauuuggacguccggaucuagcaucuccuucugcggcgucaacagcgacacagccaacuggucuuggcccgauggggcugaacucccuuuuaccauugacaaauga

SEQ ID NO: 197472 - RNA, 1410 nt, Artificial Sequence; identical to SEQ ID NO: 197406
  derived and/or modified sequence opt5 from neuraminidase__InfluenzaA__ABB02784

SEQ ID NO: 197473 - RNA, 1413 nt, Artificial Sequence; identical to SEQ ID NO: 197410
  derived and/or modified sequence opt5 from neuraminidase__InfluenzaA__ABB02795

SEQ ID NO: 197474 - RNA, 1413 nt, Artificial Sequence; identical to SEQ ID NO: 197410
  derived and/or modified sequence opt5 from neuraminidase__InfluenzaA__ABB02806

SEQ ID NO: 197475 - RNA, 1413 nt, Artificial Sequence
  derived and/or modified sequence opt5 from neuraminidase__InfluenzaA__ABB02817
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccguggagcugaaugcuccuaacuuucacuaugaagaguguucuugcuacccggacaccggcaccgugaugugugucugccgggauaauuggcacgggagcaaccgccccuggguuuccuucaaucagaaccuugacuaccaaaucggauauauuugcagcggcguguuuggggauaauccuagacccaaagacggagagggcucuuguaacccugugacagucgauggcgccaauggggugaagggauucuccuacaaauauggcaacgggguuuggaucggacggacgaaguccaaucgccugagaaaaggcuuugaaaugauuugggaccccaacggguggaccgacacagauucugacuucuccgugaagcaggaugucguggcgaucaccgacuggagcggcuacuccggaucuuuuguucagcauccggagcucacaggccuggauugcauucggccuuguuucuggguggaacuuguccgcgggcugcccaaggagaauaccacgaucuggacaagcggauccucuaucagcuucugcggcgugaacuccgacaccgccaacuggagcuggccugauggggcugaacuccccuuuaccauugacaaauga

SEQ ID NO: 197476 - RNA, 1413 nt, Artificial Sequence; identical to SEQ ID NO: 197475
  derived and/or modified sequence opt5 from neuraminidase__InfluenzaA__ABB02828

SEQ ID NO: 197477 - RNA, 1410 nt, Artificial Sequence
  derived and/or modified sequence opt5 from neuraminidase__InfluenzaA__ABB02839
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaaugauaccgugcacgaccggacgccguaucgcacacuccugaugaacgaacugggcguccccuuucaucucgggaccaaacaggugugcauugccugguccucuagcuccugucacgauggaaaggccuggcugcauguuugcgugacaggcgacgauaagaaugcuaccgccagcuucaucuacaacggcagacuugucgacucuauuguguccuggagcaaagagauccugcggacccaggaaucugagugugugugcauuaaugggacauguacggucguuaugaccgauggauccgcuagcggcaaggccgacacaaaaauccucuuuaucgaggaagggaagauugugcacaccuccacacugucuggaagcgcgcaacacguggaggaaugcuccugcuauccucgcuaccccggcgucagaugugugugccgggauaacuggaaggggagcaaccgcccuaucguugacauuaauaucaaagacuacucuauuguguccagcuaugucuguucuggacuugugggcgauacccccagaaagaacgacagcuccucuagcucccauugccuggauccgaauaacgaggaaggcgggcacggaguuaaaggcugggccuucgacgaugggaaugacguguggaugggacggacgaucagcgagaagcuccgcucuggcuacgagacauuuaaagucaucgaagggugguccaacccuaauagcaagcugcagauuaacagacaggugaucgucgaucggggaaaucgcucuggcuauuccggcauuuucagcguggaggggaaauccuguaucaacagaugcuuuuacguugaacugauucggggaagaaaggaggaaaccgaggugcucuggaccucuaauagcaucgucguguucuguggcacauccgggaccuauggaacaggcucuuggcccgacggggcugauauuaaccugaugccuaucuga

SEQ ID NO: 197478 - RNA, 1410 nt, Artificial Sequence
  derived and/or modified sequence opt5 from neuraminidase__InfluenzaA__ABB02850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacccgcugaguaccggaauugguccaagccucagugugacauuaccggguucgcccccuuuucuaaagauaacagcauccgccucuccgcgggaggcgacaucugggugacaagagagccuuaugucucuugcgauccggacaaguguuaccaauucgcucuggggcagggaaccacacuuaauaacgugcauagcaaugauaccguucacgaccggacgcccuaucgcacacugcucaugaacgaacugggcgugccuuuucaucuggggaccaagcaggucugcauugccugguccucuagcuccugucacgauggaaaagccuggcuccaugugugcguuacaggcgacgauaagaaugcuaccgccagcuucaucuacaacggcagacugguggacucuauugucuccuggagcaaagagauccuucggacccaggaaucugagugugugugcauuaaugggacaugugcuguggucaucacggauggauccgccagcggcaaggcggacaccaaaauccuguuuauugaggaagggaagaucguucacacauccaagcucucuggaagcgcccaacacguggaggaaugcuccugcuauccccgcuacccuggcauuagaugugugugccgggauaacuggaaagggagcaaccgccccaucgucgacauuaauaucaaggacuacucuaucguguccagcuauguuuguucuggacuggugggcgauaccccgcggaaaaacgacagcuccucuagcucccuuugccuggauccuaauaacgaggaaggcgggcauggagucaagggcugggcuuucgacgaugggaaugacguguggaugggaagaacaauuagcgagaaacuccgcucuggcuacgagaccuuuaagguuaucgaagggugguccaaccccaauagcaaacugcagauuaacagacaggugaucgucgaucggggaaaucgcucuggcuauuccggcauuuucagcguggaggggaaguccuguaucaacagaugcuuuuacgucgaacugauucggggaagaaaggaggaaacggaggugcucuggacaucuaauagcaucguuguguucuguggcaccuccgggaccuauggaacaggcucuuggccugacggggccgauaucaaccugaugcccauuuga

SEQ ID NO: 197479 - RNA, 1410 nt, Artificial Sequence
  derived and/or modified sequence opt5 from neuraminidase__InfluenzaA__ABB02861
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacgaugggcggcugguggacagcaucggaucuugguccaaaaagauucuccgcacccaggaaagcgagugcgucuguaucaaugggaccugcacaguggugaugacggauggcucugcguccggaaaagccgacaccaagauucuguuuaucgaggaaggcaaaaucgucaacauuagcacacuuuccgggucugcucaacacguugaggaaugcagcuguuauccuagauaccccggagugcggugcgugugucgcgauaacuggaagggcuccaauagaccuaucgucgacauuaacgugaaggacuacagcaucguuucuuccuaugugugcagcggccuggucggggauacaccccggaaaaaugacucuuucagcuccucucacugucucgauccgaacaaugaggaaggaggccauggggugaagggaugggccuuugacgauggcaacgacguuuggauggggcgcaccauuagcgagaaacugagauccggauacgagaccuucaaggugaucgaaggcuggagcaaaccuaauucuaagcugcagaucaaccggcaggucauuguggagcgcggcaauagauccggguauagcggaaucuuuucugucgaaggcaaauccugcauuaaccgguguuucuacguggagcucaucagagggcgcaaggaagagacggagguuugguggacaagcaauuccauuguggucuuuugcggaaccucuggcaccuaugggacaggcagcuggcccgauggagcugacaucgaucugaugccuauuuga

SEQ ID NO: 197480 - RNA, 1410 nt, Artificial Sequence; identical to SEQ ID NO: 197277
  derived and/or modified sequence opt5 from neuraminidase__InfluenzaA__ABB02872

SEQ ID NO: 197481 - RNA, 1410 nt, Artificial Sequence; identical to SEQ ID NO: 197277
  derived and/or modified sequence opt5 from neuraminidase__InfluenzaA__ABB02883

SEQ ID NO: 197482 - RNA, 1410 nt, Artificial Sequence
  derived and/or modified sequence opt5 from neuraminidase__InfluenzaA__ABB02894
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaaugguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucaucuacaaugggagacugguggauagcauuggaucuugguccaagaaaauccuccggacccaggaaagcgagugcgucuguauuaacggcacaugcacgguggugaugaccgacgggucugccuccggaaaggcggauacaaaaauccuguuuauugaggaaggcaagaucguccacaccagccuucuguccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccauuuccgagaagcugcgcagcggauacgagacguuuaaagugaucgaaggcuggucuaagccuaauuccaaacuccagauuaacagacaggucaucguggaccggggcaaucgcagcggguauucuggaaucuucuccgucgagggcaagagcugcauuaacagauguuuuuacguggaacugauccgggggagaaagcaggagacagaaguucuuuggaccuccaauucuauuguggucuucugcggaaccagcggcacauaugggaccggcuccuggcccgauggagccgacaucaaccugaugccuauuuga

SEQ ID NO: 197483 - RNA, 1410 nt, Artificial Sequence; identical to SEQ ID NO: 197085
  derived and/or modified sequence opt5 from neuraminidase__InfluenzaA__ABB02905

SEQ ID NO: 197484 - RNA, 1413 nt, Artificial Sequence
  derived and/or modified sequence opt5 from neuraminidase__InfluenzaA__ABB02916
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccgagaaagacaagaccucugugacacuggcgggaaauagcucccuuuguagcauuucuggcugggcuaucuacaccaaagauaacuccauucggaucgggagcaagggagacgucuucgugauucgcgagccuuuuaucucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggauuagcggaccugacaacggcgcggucgccgugcugaaauauaacgggaucauuacagagaccaucaagucuuggaaaaagcagauucucagaacgcaggaguccgaaugcguuugugugaauggaagcugcuuuacaaucaugaccgauggccccucuaacggcgcugccagcuacaaaaucuucaagauugagaaggggaaagucacaaaguccaucgaacugaaugcuccuaacuuucacuaugaggaguguucuugcuacccggacaccggaaccgugaugugugugugccgggauaauuggcacggcagcaaccgccccugggucuccuucaaucagaaccuugacuaccaaauuggguauaucugcagcggaguuuuuggcgauaauccuagaccccgggacggggaaggaucuuguaacccugugacaguggauggcgccaauggcgucaaaggguucuccuacaaguauggaaacggcguguggauugggcgcacgaaaagcaauagacugcggaagggauuugagaugaucugggaccccaacggcuggaccgacacagauucugacuucuccguuaaacaggauguggucgcgauuaccgacuggagcggguacuccggcucuuuugugcagcauccggaacucacaggacuggauugcauccgcccuuguuucuggguugagcuugugagaggccugccccgggaaaauaccacgaucuggacaagcggguccucuauuagcuucugcggagucaacuccgacaccgccaacuggagcuggccugauggcgcugagcuccccuuuaccaucgacaaguga

SEQ ID NO: 197485 - RNA, 1413 nt, Artificial Sequence
  derived and/or modified sequence opt5 from neuraminidase__InfluenzaA__ABB02927
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacaaacugagaaagggcuuugaaaugaucugggaccccaauggguggaccgauacagacucugauuucuccguuaagcaagacguggucgcgauuaccgauuggagcggcuacuccggaucuuuugugcagcauccggagcucacaggccuggacugcauccggccuuguuucuggguugaacuugugcgcgggcugcccagagagaacaccacgaucuggacaagcggauccucuauuagcuucugcggcgucaauuccgauaccgccaacuggagcuggccugacggggcugaacuccccuuuaccaucgauaaauga

SEQ ID NO: 197486 - RNA, 1413 nt, Artificial Sequence
  derived and/or modified sequence opt5 from neuraminidase__InfluenzaA__ABB02939
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacauggaugaaccacaccuaugucaauaucaacaauacaaacguuaucgccggaaaagacaagaccucugugacacuggcgggcaauagcucccuuuguagcauuucugggugggcuaucuacaccaaagauaacuccauucggaucggaagcaagggcgacguguucgucauucgcgaaccuuuuaucucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucuguugccuggagcgcuuccgccugucaugauggcaugggguggcugaccaucggaauuagcggcccugacaacggggcgguggccguccugaaauauaacggaaucauuacagaaaccaucaagucuuggaaaaagcagauucucagaacgcaggaguccgagugcguguguguuaauggcagcugcuuuacaaucaugaccgauggccccucuaacggggcugccagcuacaaaaucuucaagauugaaaagggaaaagugacaaaguccauggagcugaaugcuccuaacuuucacuaugaagaguguucuugcuacccggacaccggcaccgucaugugugugugccgggauaauuggcacgggagcaaccgccccuggguguccuucaaucagaaccuugacuaccaaaucggauauauuugcagcggcgucuuuggggauaauccuagacccaaagacggagagggcucuuguaacccuguuacaguggauggcgccaauggggugaagggauucuccuacaaauauggcaacggggucuggaucggacggacgaaguccaaucgccugagaaaaggcuuugaaaugauuugggaccccaacggguggaccgacacagauucugacuucuccgugaagcaggauguuguggcgaucaccgacuggagcggcuacuccggaucuuuuguccagcauccggagcucacaggccuggauugcauucggccuuguuucuggguggaacuuguucgcgggcugcccaaggagaauaccacgaucuggacaagcggauccucuaucagcuucugcggcgugaacuccgacaccgccaacuggagcuggccugauggggcugaacuccccuuuaccauugacaaauga

SEQ ID NO: 197487 - RNA, 1410 nt, Artificial Sequence; identical to SEQ ID NO: 197402
  derived and/or modified sequence opt5 from neuraminidase__InfluenzaA__ABB02950

SEQ ID NO: 197488 - RNA, 1410 nt, Artificial Sequence; identical to SEQ ID NO: 197303
  derived and/or modified sequence opt5 from neuraminidase__InfluenzaA__ABB02961

SEQ ID NO: 197489 - RNA, 1410 nt, Artificial Sequence; identical to SEQ ID NO: 197303
  derived and/or modified sequence opt5 from neuraminidase__InfluenzaA__ABB02972

SEQ ID NO: 197490 - RNA, 1410 nt, Artificial Sequence; identical to SEQ ID NO: 197303
  derived and/or modified sequence opt5 from neuraminidase__InfluenzaA__ABB02983

SEQ ID NO: 197491 - RNA, 1410 nt, Artificial Sequence; identical to SEQ ID NO: 197303
  derived and/or modified sequence opt5 from neuraminidase__InfluenzaA__ABB02994

SEQ ID NO: 197492 - RNA, 1410 nt, Artificial Sequence; identical to SEQ ID NO: 197303
  derived and/or modified sequence opt5 from neuraminidase__InfluenzaA__ABB03005

SEQ ID NO: 197493 - RNA, 1410 nt, Artificial Sequence; identical to SEQ ID NO: 197308
  derived and/or modified sequence opt5 from neuraminidase__InfluenzaA__ABB03016

SEQ ID NO: 197494 - RNA, 1410 nt, Artificial Sequence; identical to SEQ ID NO: 197303
  derived and/or modified sequence opt5 from neuraminidase__InfluenzaA__ABB03027

SEQ ID NO: 197495 - RNA, 1410 nt, Artificial Sequence; identical to SEQ ID NO: 197308
  derived and/or modified sequence opt5 from neuraminidase__InfluenzaA__ABB03038

SEQ ID NO: 197496 - RNA, 1410 nt, Artificial Sequence; identical to SEQ ID NO: 197303
  derived and/or modified sequence opt5 from neuraminidase__InfluenzaA__ABB03049

SEQ ID NO: 197497 - RNA, 1410 nt, Artificial Sequence
  derived and/or modified sequence opt5 from neuraminidase__InfluenzaA__ABB03060
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcaucagaugugugugccgggauaacuggaaggggagcaaccgcccuauugucgacaucaauauuaaagacuacucuaucguguccagcuauguuuguucuggacuugugggcgauacccccagaaagaacgacagcuccucuagcucccauugccuggauccgaauaacgaggaaggcgggcacggagucaaaggcugggccuucgacgaugggaaugacguguggaugggacggacgaucagcgagaagcuccgcucuggcuacgagacauuuaaaguuauugaagggugguccaacccuaauagcaagcugcagaucaacagacaggugauugucgaucggggaaaucgcucuggcuauuccggcaucuucagcguggaggggaaauccuguauuaacagaugcuuuuacgucgaacugauccggggaagaaaggaggaaaccgaggugcucuggaccucuaauagcauuguuguguucuguggcacauccgggaccuauggaacaggcucuuggcccgacggggcugauaucaaccugaugccuaucuga

SEQ ID NO: 197498 - RNA, 1410 nt, Artificial Sequence
  derived and/or modified sequence opt5 from neuraminidase__InfluenzaA__ABB03071
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacgugcauagcaaugacaccguucacgaucggacgccguaucgcacacuccugaugaacgaacugggggugcccuuucaucucggaaccaagcaggucugcauugccugguccucuagcuccugucacgacggcaaagccuggcugcaugugugcguuacaggcgaugacaagaaugcuaccgccagcuucaucuacaacgggagacuuguggauucuauugucuccuggagcaaagagauccugcggacccaggaaucugagugugugugcauuaauggaacauguacgguggucaugaccgacggcuccgcuagcgggaaggccgauacaaaaauccucuuuaucgaggaaggaaagauuguucacaccuccacacugucuggcagcgcgcaacacguggaggaaugcuccugcuauccucgcuaccccggggugagaugugucugccgggacaacuggaagggaagcaaccgcccuaucguggauauuaauaucaaagacuacucuauuguuuccagcuauguguguucuggccuugucggcgacacccccagaaagaacgauagcuccucuagcucccauugccuggacccgaauaacgaggaagggggacacggcgugaaagggugggccuucgaugacggaaaugauguuuggaugggccggacgaucagcgagaagcuccgcucuggguacgagacauuuaaagugaucgaaggaugguccaacccuaauagcaagcugcagauuaacagacaggucaucguggacaaaggcaaucggucuggcuauuccgggauuuucagcgucgagggaaaguccuguaucaaccgcugcuuuuacguggaacugauuagaggccggaaggaggaaaccgagguucucuggaccucuaauagcaucguggucuucugugggacauccggaaccuauggcacagggucuuggcccgauggcgcugacauuaaccugaugccuaucuga

SEQ ID NO: 197499 - RNA, 1410 nt, Artificial Sequence
  derived and/or modified sequence opt5 from neuraminidase__InfluenzaA__ABB03093
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacaucgaggaaugcuccugcuauccucgcuaccccggcgugagaugugugugccgggauaacuggaaggggagcaaccgcccuauugucgacaucaauauuaaagacuacucuaucguguccagcuauguuuguucuggacuugugggcgauacccccagaaagaacgacagcuccucuagcucccauugccuggauccgaauaacgaggaaggcgggcacggagucaaaggcugggccuucgacgaugggaaugacguguggaugggacggacgaucagcgagaagcuccgcucuggcuacgagacauuuaaaguuauugaagggugguccaacccuaauagcaagcugcagaucaacagacaggugauugucgaucggggaaaucgcucuggcuauuccggcaucuucagcguggaggggaaauccuguauuaacagaugcuuuuacgucgaacugauccggggaagaaaggaggaaaccgaggugcucuggaccucuaauagcauuguuguguucuguggcacauccgggaccuauggaacaggcucuuggcccgacggggcugauaucaaccugaugccuaucuga

SEQ ID NO: 197500 - RNA, 1410 nt, Artificial Sequence; identical to SEQ ID NO: 197406
  derived and/or modified sequence opt5 from neuraminidase__InfluenzaA__ABB03104

SEQ ID NO: 197501 - RNA, 1410 nt, Artificial Sequence
  derived and/or modified sequence opt5 from neuraminidase__InfluenzaA__ABB03115
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaagcaggagaacgaaguucucuggaccucuaauagcaucguggucuucuguggcaccuccgggacauauggaaccggcucuuggcccgauggggcugacauuaaccugaugccuaucuga

SEQ ID NO: 197502 - RNA, 1413 nt, Artificial Sequence; identical to SEQ ID NO: 197410
  derived and/or modified sequence opt5 from neuraminidase__InfluenzaA__ABB03126

SEQ ID NO: 197503 - RNA, 1413 nt, Artificial Sequence
  derived and/or modified sequence opt5 from neuraminidase__InfluenzaA__ABB03148
augaaccccaaucagaagaucauuaccaucggcagcauuuccaucgccauugggacaaucucucugaugcuccaaaucggaaacauuaucagcauuugggcuucccacucuauccagacgggcagccagaaucauaccgggauuugcaaccagagaaucauuacauacgaaaauuccaccugggugaaccacacauaugucaauaucaacaauaccaacguuguggccggaaaagacaagacaucugugacccuggcgggcaauagcucccuuuguagcaucucugggugggcuauuuacacgaaagauaacuccauccggauuggaagcaagggcgacgucuucgugauccgcgagccuuuuauuucuugcucccaucuggaguguagaaccuucuuucucacacaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaaucggaaucagcggcccugacaacggggcggucgccgugcugaaauauaacggaauuaucaccgaaacgauuaagucuuggaaaaagagaauccuccggacacaggaguccgagugcguuugugugaauggcagcugcuuuaccauuaugacagauggccccucuaacggggcugccagcuacaaaaucuucaagaucgaaaagggaaaagucaccaaguccauugagcugaaugcuccuaacuuucacuaugaagaguguucuugcuacccggacaccggcacagugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugacgguggauggcgccgacggggucaaaggauucuccuacaaguauggcaaugggguguggaucggacgcaccaaaagcaacagacugcggaagggcuuugagaugauuugggaccccaauggguggacagauaccgacucugauuucuccguuaagcaagacguggucgcgaucacagauuggagcggcuacuccggaucuuuugugcagcauccggaacucaccggccuggacugcauucgcccuuguuucuggguugagcuugugagagggcugccccgggaaaacacgacaaucuggaccagcggauccucuaucagcuucugcggcgucgauuccgacaccgccaauuggagcuggccugauggggcugagcuccccuuuacaauugacaaauga

SEQ ID NO: 197504 - RNA, 1410 nt, Artificial Sequence
  derived and/or modified sequence opt5 from neuraminidase__InfluenzaA__ABB04286
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacgccccaucgcacccuccugaugaacgaacugggggugccuuuucaccucggaacaagacaggucuguaucgccugguccuccucuuccugccaugacggcaaggccuggcugcacguguguguuaccggcuaugauaaaaaugcuacagccagcuucauuuacgacgggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacauguugaggaaugcuccuguuauccucgguaccccggggugcgcugcguguguagagacaacuggaagggaagcaaucggccggucguggauaucaacguuaaagacuacucuauuguguccagcuaugucugcucuggccuugugggcgacacaccucgcaagaacgauagaagcuccucuagcuacugucggaaucccaacaaugagaaagggaaccacggaguuaagggcugggccuucgacgaugggaaugacguguggaugggacgcaccaucuccgaagagagcagaucuggcuaugagacauuuaaagucaucgggggaugguccaccccuaacagcaagucucagauuaauagacaggugaucgucgauuccggcaaccggagcggcuacuccgggauuuucucuguggaaggaaaaagcugcaucaaucgcuguuuuuauguugagcugauucggggcagagaacaggagacgcgcgugugguggacauccaacucuaucgucguguucugcgggaccagcggaaccuacggcacaggguccuggcccgacggcgcugauauuaaucucaugcccaucuga

SEQ ID NO: 197505 - RNA, 1410 nt, Artificial Sequence
  derived and/or modified sequence opt5 from neuraminidase__InfluenzaA__ABB04297
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaucccgugcgaacccauuacaaucgagagaaacauuaccgaaaucguguaucugacaaauaccacgauugagaaggaaaucuguccuaaacucgucgaguaccggaacuggagcaagccccagugcaaaauuaccggguucgcgccuuuuuccaaggauaauucuauccgccugagcgcuggaggcgacaucugggugacaagagagcccuauguuuccugugauccugggaagugcuaccaauucgcccuuggacagggcaccacacuggacaacaaacauucuaaugauaccauucacgaccggacgccgcaucgcacacuccugaugaacgaacugggggugcccuuucaccucggaaccagacaggucuguaucgccuggagcuccagcucuugccaugauggcaaggcuuggcugcacguguguguuacaggcuaugacaaaaaugccaccgcuuccuucauuuacgaugggcggcuuguggacagcaucggaucuuggucccagaacauucugcgcacccaagagagcgaaugcgucuguaucaauggcacaugcacgguggugaugaccgaugggucugccuccggacgggcggacacaaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacaccccgcgcaacaaugauagaucuagcaacuccuacugucggaauccuaacaaugaaaaaggaaaccacggcgucaaggggugggcuuucgacgauggaaaugacguguggaugggccgcacaaucucugaggauagcagauccggguaugaaaccuuuaaaguuauuggaggcuggagcacgcccaacucuaagcugcagaucaauagacaggugauugucgacuccgauaacagaagcggcuacucugggaucuucuccguggagggaaaaagcugcauuaaucgcuguuuuuaugucgagcucauccggggcagagaacaagagacacgcgugugguggaccuccaacucuauuguuguguucugcgggaccagcggaacauacggcaccggguccuggccugacggcgccgauaucaaucugaugcccaucuga

SEQ ID NO: 197506 - RNA, 1410 nt, Artificial Sequence
  derived and/or modified sequence opt5 from neuraminidase__InfluenzaA__ABB04319
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacaaugggcggcuugucgauucuaucggauccuggagcaagaacauucugcgcacccaggagucugaaugcguguguaucaauggcacaugcacgguggucaugaccgacggguccgcuagcgagagagccgauacaaaaauucucuuuaucgaggaaggaaagaucguucacauuagcccccugucuggcagcgcgcaacauguggaggaaugcuccuguuauccucgguaccccggggugcgcugcgucuguagagacaacuggaagggaagcaaccggccgaucguggauauuaauguuaaagacuacucuaucguguccagcuaugucugcucuggccuugugggcgauaccccucgcaagaacgacagaagcuccucuagcuacugucagaaucccaacaaugagaaagggucccacggaguuaagggcugggccuucgacgaugggaacgacguguggaugggacggacaauuggcgaggaacugcgcagcggguaugagaccuuuaaagucaucggaggcuggucuacgccuaauuccaagcuccagaucaacagacaggugauugucgauagcggcaaucggucuggguacuccggaaucuucagcguggaaggcaaauccugcauuaacagauguuuuuauguugagcugauccgcgggcggaagcaagaaacaagagugugguggaccucuaauagcauugucguguucugcggaaccuccggcacauacgggaccggcucuuggcccgacggagcugauaucaaccugaugcccauuuga

SEQ ID NO: 197507 - RNA, 1410 nt, Artificial Sequence
  derived and/or modified sequence opt5 from neuraminidase__InfluenzaA__ABB04341
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucugugcgccugagcgcuggaggcgacaucuggguuaccagagagcccuauguguccugugauccugggaagugcuaccaauucgcccuuggacagggcacaacccuggacaacaaacauucuaaugauacaauccacgaccggaccccgcaucgcacgcuccugaugaacgaacuggggguccccuuucaccucggaacaagacagguguguauugccuggagcuccagcucuugccaugauggcaaggcuuggcugcacguuugugugaccggcuaugacaaaaaugccacagcuuccuucaucuacgaugggcggcuugucgacagcauuggaucuuggucccagaacauccugcgcacccaagagagcgaaugcguguguauuaauggaaccugcacaguggucaugacggaugggucugccuccggcagagcggacaccaagauccucuuuaucgaggagggcaaaauuguucacaucagcccucuguccgggucugcccagcauguggaagagugcagcuguuauccccgguacccuggagugcgcugcauuuguagagauaacuggaagggcuccaaucggcccgucguggacaucaacguuaaggacuacagcauugauucuuccuaugugugcagcggccuugucggggacacaccgcgcaaaaacgauagaucuagcaauuccuacugucggaacccuaauaacgaaaagggaaaucacggcgugaaagggugggcuuucgacgauggaaacgacguuuggaugggccgcaccaucucugaggauagcagauccggguaugaaacauuuaaggugaucggaggcuggagcacccccaauucuaaacugcagauuaaccggcaggucaucguggacuccgauaauagaagcggcuacucugggauuuucuccgucgagggaaagagcugcaucaaccgcuguuuuuauguggagcucauucggggcagagaacaagagacgcgcguuugguggacauccaauucuaucguggucuucugcgggaccagcggaaccuacggcacaggguccuggccugacggcgccgauauuaaccugaugcccaucuga

SEQ ID NO: 197508 - RNA, 1410 nt, Artificial Sequence
  derived and/or modified sequence opt5 from neuraminidase__InfluenzaA__ABB04352
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacagugcacgaccggacccccuaucgcacgcuccugaugaaugaacugggggucccuuuucaucucggaacaaaacagguguguauugccugguccuccucuuccugccacgauggcaaggccuggcugcauguuugugugaccggccacgacaagaacgcuacagccagcuucaucuacgaugggagacuugucgacucuauuggauccuggagcaaaaauauccugcggacccaggagucugaaugcguguguauuaacgggaccugcacaguggucaugacggauggcuccgcuagcgagcgcgccgacaccaagauccucuuuaucgaggaaggaaagauuguucacaucagcccccugucuggcagcgcgcaacauguggaggaaugcuccuguuauccuagauaccccggggugcggugcgucugucgcgauaauuggaaaggaagcaacagaccgauuguggacaucaacguuaaggauuacucuauuguguccagcuaugucugcucuggccuugugggcgacacaccucggaaaaaugaccgcagcuccucuagcuacuguagaaaccccaauaacgagaaggggucccacggaguuaaaggcugggccuucgaugacgggaaugauguguggaugggacggaccaucggcgaggaacugcgcagcggguaugagacauuuaaggucaucggaggcuggucuaccccuaacuccaaacuccagauuaauagacaggugaucgucgacagcggcaaccggucuggguacuccggaauuuucagcguggaaggcaaguccugcaucaauagauguuuuuauguugagcugauucgcgggcgggaacaggagacgagagugugguggacaucuaacagcaucgucguguucugcggaaccuccggcaccuacgggacaggcucuuggcccgauggagcugacauuaaucugaugcccaucuga

SEQ ID NO: 197509 - RNA, 1410 nt, Artificial Sequence
  derived and/or modified sequence opt5 from neuraminidase__InfluenzaA__ABB04374
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguccccuuucaccucggaacgagacagguguguaucgccuggagcuccagcucuugccaugauggcaaggcuuggcugcacguuugugugacaggcgacgaugagaaugccaccgcuuccuucauuuaugacgggcggcuugucgauagcaucggaucuuggucccagaacauucugcgcacacaagaaagcgagugcguguguaucaauggaaccugcaccguggucaugacagacgggucugccuccggcagagcggauacgcggauccucuuuauugaggaaggcaaaaucguucacauuagcccucuguccgggucugcccagcauguggaggaaugcagcuguuacccccgcuauccuggagugagaugcaucugucgggacaacuggaagggcuccaaucgccccgucguggacauuaacguuaaagauuacagcaucgacucuagauacgugugcuccggccuugucggggauaccccgcggaacaaugacaagagcucuaacagcaauugucgcaacccuaauaacgauaagggaaaucacggcgugaaagggugggcuuucgacgauggaaacgacguuuggaugggcagaacaaucuccaaggauucucggagcggguaugagaccuuuaaagugauuggaggcugguccacacccaauagcaagucucagaucaacagacaggucauuguggacuccgauaaucgcagcggcuacucugggaucuucuccgucgaaggaaaaagcugcauuaaccgguguuuuuauguggagcugaucagaggccgcgagcaagaaaccaagguuugguggacguccaauucuauuguggucuucugcgggacaagcggaaccuacggcaccggguccuggccugacggcgccgacaucaaccucaugcccaucuga

SEQ ID NO: 197510 - RNA, 1410 nt, Artificial Sequence
  derived and/or modified sequence opt5 from neuraminidase__InfluenzaA__ABB04931
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaacaaugauagaucuagcuccucuuacugucggaacccuaauaacgaaaaaggaaagcacggcgucaaagggugggcuuucgacgauggaaaugacguguggaugggccgcaccaucagcgaggauuccagaagcggguaugaaacauuuaagguuauuggaggcuggucuacccccaacuccaaacugcagaucaauagacaggugauugucgacagcgauaaccggucuggcuacuccgggaucuucagcguggagggaaaguccugcauuaaucgcuguuuuuaugucgagcucauccggggcagagaacaagagacgcgcgugugguggacaucuaacagcauuguuguguucugcgggaccuccggaaccuacggcacagggucuuggccugacggcgccgauaucaaucugaugcccaucuga

SEQ ID NO: 197511 - RNA, 1410 nt, Artificial Sequence
  derived and/or modified sequence opt5 from neuraminidase__InfluenzaA__ABB04942
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacaauucacgaccggacccccuaucgcacgcuccugaugaaugaacugggggugccuuuucaucucggaacaaagcaggucuguaucgccugguccuccucuuccugccacgauggcaaagccuggcugcauguguguguuaccggccacgacaagaacgcuacagccagcuucauuuacgaugggagacuuguggacucuaucggauccuggagcaaaaauauucugcggacccaggagucugaaugcgucuguaucaacgggaccugcacaguggugaugacggauggcuccgcuagcgagcgcgccgacaccaagauccucuuuauugaggaaggaaagaucguccacauuagcccccugucuggcagcgcgcaacauguugaggaaugcuccuguuauccuagauaccccggggugcggugcgugugucgcgauaauuggaaaggaagcaacagaccgaucgucgacauuaacgugaaggauuacucuaucguuuccagcuaugugugcucuggccuugucggcgacacaccucggaaaaaugaccgcagcuccucuagcuacuguagaaaccccaauaacgagaaggggaaucacggagugaaaggcugggccuucgaugacgggaacgauguuuggaugggacggaccaucggcgaggaacugcgcuccggguaugagacauuuaaggugauuggaggcuggagcaccccuaauucuaaacuccagaucaacagacaggucauuguggacuccgauaaucggagcggcuacucugggaucuucuccgucgaaggaaagagcugcauuaacagauguuuuuauguggagcugauccgcggccgggaacaggagacgagaguuugguggacauccaauucuauuguggucuucugcgggaccagcggaaccuacggcacaggguccuggcccgacggcgcugauaucaaccugaugcccaucuga

SEQ ID NO: 197512 - RNA, 1410 nt, Artificial Sequence; identical to SEQ ID NO: 197508
  derived and/or modified sequence opt5 from neuraminidase__InfluenzaA__ABB04953

SEQ ID NO: 197513 - RNA, 1410 nt, Artificial Sequence; identical to SEQ ID NO: 197406
  derived and/or modified sequence opt5 from neuraminidase__InfluenzaA__ABB04975

SEQ ID NO: 197514 - RNA, 1410 nt, Artificial Sequence; identical to SEQ ID NO: 197204
  derived and/or modified sequence opt5 from neuraminidase__InfluenzaA__ABB04986

SEQ ID NO: 197515 - RNA, 1410 nt, Artificial Sequence
  derived and/or modified sequence opt5 from neuraminidase__InfluenzaA__ABB04997
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauugugcaucucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccaagcaggucuguaucgccuggagcuccagcucuugccaugacggcaaagccuggcuucacguguguguuacaggcgaugacgagaacgcuaccgcuuccuucauuuauaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacauguugaggaaugcagcuguuacccucgcuaucccggagugagaugcgugugucgggacaacuggaagggcuccaaucgcccuauugucgauaucaacgugaaagacuacagcauuguuucuuccuacgugugcagcggccucgucggggacacacccagaaagaaugauucuagcuccucuagccacugucuggacccgaacaaugaggaaggaggccauggggugaaaggaugggcuuucgaugacggcaacgauguuuggauggggcggaccaucuccgagaagcugcgcagcggauaugagacguuuaaagugauugaaggcuggucuaagccuaauuccaaacuccagaucaacagacaggucaucguggaccggggcaaucgcagcggguacucuggaauuuucuccgucgagggcaagagcugcaucaacagauguuuuuauguggaacugauucgggggagaaagcaggagacagaaguucuuuggaccuccaauucuaucguggucuucugcggaaccagcggcacauacgggaccggcuccuggcccgauggagccgacauuaaccugaaaccuaucuga

SEQ ID NO: 197516 - RNA, 1410 nt, Artificial Sequence; identical to SEQ ID NO: 197277
  derived and/or modified sequence opt5 from neuraminidase__InfluenzaA__ABB05008

SEQ ID NO: 197517 - RNA, 1410 nt, Artificial Sequence; identical to SEQ ID NO: 197085
  derived and/or modified sequence opt5 from neuraminidase__InfluenzaA__ABB05186

SEQ ID NO: 197518 - RNA, 1410 nt, Artificial Sequence; identical to SEQ ID NO: 197277
  derived and/or modified sequence opt5 from neuraminidase__InfluenzaA__ABB05219

SEQ ID NO: 197519 - RNA, 1410 nt, Artificial Sequence
  derived and/or modified sequence opt5 from neuraminidase__InfluenzaA__ABB46395
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaacaggugaugccgugcgaacccaucauuaucgagagaaauauuacagaaaucguguaucugaccaacacaaccauugagaaagaaaucuguccuaagcucgucgaguaccggaauuggagcaaaccccagugcaagauuacgggguucgcgccuuuuuccaaggauaacucuauccgccugagcgcuggaggcgacaucugggugaccagagagcccuauguuuccugugauccugggaaaugcuaccaauucgcccuuggacagggcacaacccuggacaauaagcauucuaacgauacaauucacgaccggaccccgcaucgcacgcuccugaugaaugaacugggggugcccuuucaccucggaacaagacaggucuguaucgccuggagcuccagcucuugccaugauggcaaggcuuggcugcacguguguguuaccggcuaugacaagaacgccacagcuuccuucauuuacgaugggcggcuuguggacagcaucggaucuuggucccagaauauucugcgcacccaagagagcgaaugcgucuguaucaacggaaccugcacaguggugaugacggaugggucugccuccggcagagcggacaccaaaauccucuuuauugaggagggcaagaucguccacauuagcccucuguccgggucugcccagcauguugaagagugcagcuguuauccccgguacccuggagugcgcugcaucuguagagauaauuggaagggcuccaaccggcccguggucgacauuaaugugaaagacuacagcaucgauucuuccuauguuugcagcggccuugugggggacacaccgcgcaacaacgauagaucuagcuccucuuacugucggaauccuaacaaugaaaagggaacccacggcgucaaagggugggcuuucgacgauggaaacgacguguggaugggccgcacaaucagcgaggauuccagaagcggguaugaaaccuuuaagguuauuggaggcuggucuacgcccaauuccaaacugcagaucaacagacaggugauugucgacagcgauaaucggucuggcuacuccgggaucuucagcguggagggaaaguccugcauuaaccgcuguuuuuaugucgagcucauccggggcagagaacaagagacacgcgugugguggaccucuaauagcauuguuguguucugcgggaccuccggaacauacggcaccgggucuuggccugacggcgccgauaucaaccugaugcccaucuga

SEQ ID NO: 197520 - RNA, 1410 nt, Artificial Sequence; identical to SEQ ID NO: 197064
  derived and/or modified sequence opt5 from neuraminidase__InfluenzaA__ABB46417

SEQ ID NO: 197521 - RNA, 1410 nt, Artificial Sequence
  derived and/or modified sequence opt5 from neuraminidase__InfluenzaA__ABB46428
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagcccucuuuccgggucugcccaacacguugaggaaugcagcuguuauccccgcuacccuggagugagaugcgugugucgggacaacuggaagggcuccaaucgccccaucgucgauauuaacgugaaagacuacagcaucguuucuuccuaugugugcagcggccuggucggggacaccccgagaaagaaugauucuuucagcuccucucauugucucgacccuaacaaugaggaaggaggccacggggugaaaggaugggcuuuugaugacggcaacgauguuuggauggggcggacaauuagcgagaagcugcgcuccggauacgagaccuucaaagugaucgaaggcuggagcaagcccaauucuaaacugcagaucaacagacaggucauuguggaccggggcaaucgcuccggguauagcggaaucuuuucugucgagggcaaguccugcauuaacagauguuucuacguggaacucauccgggggagaaaggaggaaacggagguuugguggacaagcaauuccauuguggucuuuugcggaaccucuggcaccuaugggacaggcagcuggccugauggagccgacaucaaccugaugcccauuuga

SEQ ID NO: 197522 - RNA, 1410 nt, Artificial Sequence
  derived and/or modified sequence opt5 from neuraminidase__InfluenzaA__ABB46439
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaauggggcuuguacaguggucaugacggauggauccgccagcggcaaggcggacaccaaaauccucuuuaucgaggaacgcagaauuguucacacauccacccugucugggagcgcccaacacguggaggaaugcuccugcuauccucgguaccccggagugcgcugugucugcagagauaacuggaagggcagcaaccggccuaucguggacauuaauaucaaggacuacucuauuguuuccagcuauguguguucugggcuugucggagauacaccccgcaaaaacgacagcuccucuagcuccaauugccuggauccgaacaaugaggaaggcggccauggggugaagggaugggcuuucgacgauggcaacgacguuuggauggggagaaccaucagcgagaaacuccggucuggauacgagacguuuaaggugaucgaaggcugguccaauccuaacagcaaacugcagauuaaucgccaggucaucguggauagagggaaccggucuggauauuccggcauuuucagcgucgagggcaaguccuguaucaauagaugcuuuuacguggaacugauucgcgggcggaaagaggaaacagagguucucuggaccucuaacagcaucguggucuucuguggaaccuccggcgccuaugggacaggaucuuggcccgacggcgcugauauuaaucugaugccuaucuga

SEQ ID NO: 197523 - RNA, 1410 nt, Artificial Sequence; identical to SEQ ID NO: 197370
  derived and/or modified sequence opt5 from neuraminidase__InfluenzaA__ABB46450

SEQ ID NO: 197524 - RNA, 1410 nt, Artificial Sequence; identical to SEQ ID NO: 197351
  derived and/or modified sequence opt5 from neuraminidase__InfluenzaA__ABB46461

SEQ ID NO: 197525 - RNA, 1410 nt, Artificial Sequence
  derived and/or modified sequence opt5 from neuraminidase__InfluenzaA__ABB46550
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacgccccaucgcacccuccugaugaacgaacugggggugccuuuucaccucggaacaagacaggucuguaucgccugguccuccucuuccugccaugacggcaaggccuggcugcacguguguguuaccggcuaugauaaaaaugcuacagccagcuucauuuacgacgggcggcuuguggauucuaucggauccuggagcaagaacauucugcgcacccaggagucugaaugcgucugugugaaugggaccugcacaguggucaugacggacggcuccgcuagcgagagagccgauaccaaaauccucuuuaucgaggaaggaaagauuguucacaucagcccccugucuggcagcgcgcaacauguggaggaaugcuccuguuauccucgguaccccggggugcgcugcgucuguagagacaacuggaagggaagcaaucggccggugguugauauuaacgugaaagacuacucuaucgucuccagcuaugugugcucuggccuuguuggcgacacaccucgcaagaacgauagaagcuccucuagcuacugucggaaucccaacaaugagaaagggaaccacggagugaagggcugggccuucgacgaugggaaugacgucuggaugggacgcaccauuuccgaagagagcagaucuggcuaugagacauuuaaagugaucgggggaugguccaccccuaacagcaagucucagaucaaucggcaggucauuguggauuccggcaacagaagcggcuacuccgggaucuucucuguugaaggaaaaagcugcauuaaucgcuguuuuuauguggagcugauccggggcagagaacaggagacgcgcgucugguggacauccaacucuauugugguuuucugcgggaccagcggaaccuacggcacaggguccuggcccgacggcgcugauaucaaucucaugcccauuuga

SEQ ID NO: 197526 - RNA, 1410 nt, Artificial Sequence
  derived and/or modified sequence opt5 from neuraminidase__InfluenzaA__ABB51955
augaaccccaaucagaagaucauuaccaucggcagcgugucccugacaauuucuacgaucugcuucuuuaugcaaauugccauccucgucaccacaguuacccugcacuucaaacaguacgaguguaacagcccuccgaauaaccaggugaugcuuugcgaacccacaaucauugagagaaauaucaccgaaauuguguaucugacaaacaccacgaucgagaaggaaauuuguccuaaacucgcugaguaccggaauugguccaagccccagugcaacaucaccggguuugccccuuucucuaaagacaauagcauucgccuguccgcgggaggcgauaucugggucacaagagagcccuaugugucuugugacccugauaagugcuaccaauuugcucuugggcagggaaccacacugaacaauggccauagcaacgacaucguucacgaucggaccccguaucgcacgcuccugaugaaugaacugggggugcccuuccaucucggaacaaagcaggucuguauugccugguccucuagcuccugccacgacggcaaagccuggcugcauguguguguuaccggcgaugacgagaacgcuacagccagcuuuaucuacaaugggagacuuguggauucuauuggauccuggagcaagaaauucuuucggacccaggaaucugagugcgucuguauccacgggaccugcacaguggugaugacggacggcuccgcuagccgcaaggccgauaccaaaauucuguucaucgaggaaggaaagaucguccacacauccacccucucuggcagcgcgcaacauguugaggaaugcuccuguuauccuagauaccccggggugcggugcgugugucgcgacaacuggaagggaagcaacagaccuauugucgauaucaauauuaaagacuacucuaucguguccagcuauguuugcucuggccuggugggcgacacaccccggaagaacgauagcuccucuagcucccacugucuugacccgaauaacgaggaagggggacauggcgucaaagggugggccuuugaugacggaaaugauguguggaugggccgcaccauuagcgagaagcugagaucuggguacgagacguucaaaguuaucgaaggaugguccaagccuaacagcaaacuccagaucaaucgccaggugauugucgaccggggcaacagaucuggcuauuccgggaucuuuagcguggagggaaaguccugcauuaaucgguguuucuacgucgaacugaucagaggccgcaagcaggagacagaagugcuguggaccucuaacagcauuguuguguucugcgggaccuccggaacauauggcaccgggucuuggcccgauggcgcugacaucaaucucaugccuauuuga

SEQ ID NO: 197527 - RNA, 1413 nt, Artificial Sequence
  derived and/or modified sequence opt5 from neuraminidase__InfluenzaA__ABB51956
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggugaaccacaccuauguuaauaucaacaauacaaacgugaucgccggaaaagacaagaccucugugacagucgcgggcaauagcucccuguguagcauuucugggugggcuaucuacaccaaagauaacuccauucggaucggaagcaagggcgacguguucguuauucgcgaaccuuuuaucucuugcucccaucuugaguguagaacguucuuucugacccaaggcgcccuccugaaugauaaacacagcaacgggacagugaaggaccggucuccguaucgcgcccuuauguccugcccccugggagaagcuccuagccccuacaauuccaaguucgagucugucgccuggagcgcuuccgccugucaugauggcaugggguggcucaccaucggaauuagcggcccugacaacggggcgguggccguucugaaauauaacggaaucauuacagaaaccaucaagucuuggaaaaagcccauucugggcacgcaggaguccgagugggugugcgucaauggcagcuguuuuacaaucaugaccgaugacccuucuuacgaagcugccagcuauaaaaucuucaagauugagagagaacgggugacaaaguccaucgagcucaacgcuccgaauuuucacuacgaggaaugcucuuguuaccccgauaccgggaccgugaugugcgucugucgcgacaacuggcacggaagcaauagaccuuggguuuccuucaaccagaaucuggauuaucagauuggcuacaucugcagcgggguguuuggagacaacccccggccuaaagauggcgaggggucuugcaaucccgugacagucgacggagccaacggcgugaagggcuucuccuauaaauacgggaauggaguuuggauuggccgcacgaaguccaacagacuucggaaaggguuugaaaugaucugggacccgaauggauggaccgauacagacucugauuucuccgugaagcaagacgucguggcgauuaccgauuggagcggcuauuccgggucuuuuguucagcauccugagcugacaggccucgacuguauccgccccugcuucuggguggaacuggucagaggacuuccuaaagagaacaccacgaucuggacaagcggcuccucuauuagcuucuguggggucaauuccgauaccgccaacuggagcuggcccgacggagcugagcugcccuuuaccaucgauaaguga

SEQ ID NO: 197528 - RNA, 1410 nt, Artificial Sequence
  derived and/or modified sequence opt5 from neuraminidase__InfluenzaA__ABB51957
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucgggaucgcacgccguacagaacacugcugaugaaugaacucggggugcccuuucaucugggaacccggcaggucuguaucgccuggagcuccagcucuugccacgacggcaaggcuuggcuucauguguguguuacaggcgaugacaaaaacgccaccgcuuccuucauuuauaaugggcgccugguggauagcaucggaucuugguccaagaaaauuuuuagaacccagaaguucgagugcgucuguauccacuggacaugcacgguggugaugaccgacggcagcgccucugggaaagcggauacaaagauucucuuuaucgaagagggaaagaucguccacauuuccacccugagcggcuccgcccaacauguugaggaaugcucuuguuacccucgguaucccggggugcgcugcguguguagagacaacuggaaaggaagcaaccggccuaucgucgauauuaaugugaaggacuacuccaucguuagcucuuacgugugcuccggccuugucggcgacacaccccgcaaaaacgauagcuucucuagcucccacugucuggacccgaauaacgaggaagggggacauggcgugaaggggugggcuuuugaugacggaaaugauguuuggaugggcagaaccauuucugagaaacuccggagcggguaugaaacguucaaggugaucgagggaugguccaaaccuaacagcaagcugcagaucaaucgccaggucauuguggagagaggcaaccggucuggcuacuccgggaucuuuagcgucgaaggaaagucuugcauuaauagauguuucuauguggagcugauccgcggccggaaagaagagacagaaguuugguggaccuccaacagcauuguggucuucugcgggaccuccggaacauacggcaccgggucuuggcccgacggcgccgauaucaaucucaugccuauuuga

SEQ ID NO: 197529 - RNA, 1413 nt, Artificial Sequence
  derived and/or modified sequence opt5 from neuraminidase__InfluenzaA__ABB51958
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuucuaucaauaacacaaaugugaucgccggaaaagacaagaccagcgugacacuggcgggcaacuccagccuuuguccuauucgggggugggcuaucuacaccaaaggaaauucuauucgcaucggcuccaagggcgaugucuucgugauuagagagccguuuaucagcugcucucaucuggagugucggacguucuuucucacccaaggggcccugcuuaacgacaaacacuccaauggaacaguuaaggaucgcagccccuauagagcccugaugucuugcccucucggcgaagcucccuccccuuacaacagcaaguucgaguccguggccuggucugcuagcgccugucaugacgggaugggauggcugaccaucggcauuuccgggcccgauaauggagcggucgccgugcugaaauauaacggcaucauuacagaaaccaucaagagcuggaaaaagcagauucuccggacgcaggagucugagugcguuugugugaacggcuccugcuuuacaaucaugaccgacgggccuagcaauggagcugccucuuacaaaaucuucaagauugaaaagggcaaagucacaaagagcaucgagcugaacgcuccgaauuuucacuaugaagaguguucccgcuaccccgauaccgggaccgugaugugcguguguagagacaacuggcacggaucuaaucggccuugggucagcuucaaccagaaucuugauuaccaaauuggcuauaucugcuccgggguuuuuggagacaacccccgcccuaaagauggcgagggcagcugcaaucccgugacaguggacggggccaacggagucaagggcuucucuuacaaauaugggaauggagugggcauugggagaacgaucuccaaccggcugcgcaagggcuuugaaaugauuugggauccgaauggauggaccgacacagacagcgauuucucuguuaaacaggacguggucgcgaucaccgauugguccggcuacagcggguccuuugugcagcauccugagcucacaggacuggacuguaucagacccugcuucuggguugaacuugugcggggccugccuaaggagaacaccacgauuuggacaucugggagcuccaucucuuucuguggagucaauagcgauaccgccaacugguccuggcccgacggcgcugaacuccccuuuaccauugauaaguga

SEQ ID NO: 197530 - RNA, 1410 nt, Artificial Sequence
  derived and/or modified sequence opt5 from neuraminidase__InfluenzaA__ABB51959
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacggccggacgccguaucgcacacuccugaugaacgaacugggggugcccuuucaucucggaaccaagcaggucugcauugccugguccucuagcuccugucacgacggcaaagccuggcugcaugugugcguuacaggcgaugacaagaaugcuaccgccagcuucaucuacaacgggagacuuguggauucuauugucuccuggagcaaagagauccugcggacccaggaaucugagugugugugcauuaauggaacauguacgguggucaugaccgacggcuccgcuagcgggaaggccgauacaaaaauccucuuuaacgaggaaggaaagaucguucacaccuccacaugcucuggcagcgcgcaacacguggaggaaugcuccuguuauagccgcuacccuggggugagaugcgucugucgggacaacuggaagggaucuaaucgccccauuguggauaucaacauuaaagacuacuccaucguuagcucuuaugugugcagcggccuggucggcgacaccccuagaaagaaugauuccucuagcuccagccauugucuugaccccaacaaugaggaagggggacacggcgugaaagggcgggccuucgaugacggaaacgauguuuggaugggccgcacgauuucugagaagcugagauccggguacgagacauuuaaagugaucgaaggauggagcaauccgaacucuaagcuccagaucaaucggcaggucauuguggaccgcggcaacagauccggcuauagcgggaucuucuccgucgagggaaaaucuugcauuaaucgguguuuuuacguggaacugaucagaggccgcaaggaggaaaccgagguucuguggaccagcaacuccauuguggucuucugcgggacaucuggaaccuauggcacagggagcuggccugauggcgcugacaucaaucucaugcccauuuga

SEQ ID NO: 197531 - RNA, 1413 nt, Artificial Sequence
  derived and/or modified sequence opt5 from neuraminidase__InfluenzaA__ABB51960
augaaccccaaucagaagaucauuaccaucggcagcauuuccaucgccauugggaucaucucucugaugcuccaaauuggaaacaucauuccuaucugggcuagccacuccauucagacaggcucucagaaucauacgggggugugcaaccagagaaucauuaccuacgagaauagcacaugggucaaccacaccuauguuaauaucaacaauacaaacgugaucgccggaaaagacaagaccuccgugacacuggcgggcaauucuagccuuuguuccauuagcgggugggcuaucuacaccaaagauaacucuauucggaucggauccaagggcgacgucuucgugauucgcgaaccguuuaucagcugcucucaucuggaguguagaacguucuuucucacccaaggcgcccugcuuaaugauaaacacuccaacgggacaguuaaggaccggagccccuaucgcgcccugaugucuugcccucucggagaagcucccuccccuuacaauagcgaguucgaauccguggccuggucugcuagcgccugucaugauggcaugggguggcugaccaucggaauuuccggccccgacaacggggcggucgccgugcugaaguauaacggaaucauuacagagaccaucaaaagcuggaagaaacagauucucagaacgcaggagucugaaugcguuugugugaauggcuccugcuuuacaaucaugaccgauggcccuagcaacggggcugccucuuacaagaucuucaaaauugagaagggaaagaucacaaaaagcauugaacugaaugcuccgaacucccacuaugaggaguguucuugcuaccccgacaccggcaccgucaugugugugugccgggauagcuggcacggguccaaucgcccuugggugagcuuuaaccagaaucuugacuaccaaaucggauauauuugcucuggcgucuucggggauaaccccagaccuaaggacggagaaggcuccuguaaucccguuacaguggauggcgccaacggggugaaaggauuuagcuacgaguauggcaauggggacuggaucggacggacgaagucuaaccgccugagaaaaggcuucgaaaugauuugggacccggauggguggaccgacacaaauuccgauuuuagcgucaagcaggacgugguugcgaucaccgauugguccggcuacucuggcagcuucgugcagcauccugagcucacaggacuggucugcauccggcccuguuuuuggguggaacuuguucgcgggcugccuaaagagaacaccacgauuuggacauccggaucuagcaucuccuucugcggcgugaauagcgacaccgccaacuggucuuggcccgauggggcugagcuccccuucaccauugacaaguga

SEQ ID NO: 197532 - RNA, 1410 nt, Artificial Sequence; identical to SEQ ID NO: 197367
  derived and/or modified sequence opt5 from neuraminidase__InfluenzaA__ABB53617

SEQ ID NO: 197533 - RNA, 1410 nt, Artificial Sequence
  derived and/or modified sequence opt5 from neuraminidase__InfluenzaA__ABB53721
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccucuggaggcgacaucugggugacaagagagcccuaugucagcugcgauccugacaaguguuaccaauucgcgcuugggcagggaaccacacugaauaacgugcauuccaaugauaccguucacgaccggacgccguaucgcacacuccugaugaacgaacugggcgugcccuuucaucucgggaccaagcaggucugcauugcuuggucuagcuccagcugucacgauggaaaagccuggcugcaugugugcguuacaggcgacgauaagaaugccaccgcuucuuucaucuacaacggcagacuuguggacuccauugucagcuggucuaaagagauccugcggacccaggaauccgagugugugugcauuaaugggacauguacgguggucaugaccgauggaagcgccuccggcaaggcugacacaaaaauccucuuuaucgaggaagggaagauuguucacaccucuacacugagcggauccgcccaacacguggaggaaugcagcugcuauccucgcuaccccggcgugagaugugucugccgggauaacuggaaggggucuaaccgcccuaucguggacauuaauaucaaagacuacuccauuguuagcucuuauguguguagcggacuugucggcgauacccccagaaagaacgacuccucuagcuccagccauugccuggauccgaauaacgaggaaggcgggcacggagugaaaggcugggcguucgacgaugggaaugacguuuggaugggacggacgaucucugagaagcuccgcuccggcuacgagacauuuaaagugaucgaaggguggagcaacccuaauucuaagcugcagauuaacagacaggucaucguggaucggggaaaucgcuccggcuauagcggcauuuucuccgucgaggggaaaucuuguaucaacagaugcuuuuacguggaacugauucggggaagaaaggaggaaaccgagguucucuggaccagcaauuccaucguggucuucuguggcacaucugggaccuauggaacaggcagcuggcccgacggggccgauauuaaccugaugccuaucuga

SEQ ID NO: 197534 - RNA, 1410 nt, Artificial Sequence
  derived and/or modified sequence opt5 from neuraminidase__InfluenzaA__ABB53754
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacgccccaucgcacccuccugaugaacgaacugggggugccuuuucaccucggaacaagacaggucuguaucgccugguccuccucuuccugccaugacggcaaggccuggcugcacguguguguuaccggcuaugauaaaaaugcuacagccagcuucauuuacgacgggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacauguugaggaaugcuccuguuauccucgguaccccggggugcgcugcguguguagagacaacuggaagggaagcaaucggccggucguggauaucaacguuaaagacuacucuauuguguccagcuaugucugcucuggccuugugggcgacacaccucgcaagaacgauagaagcuccucuagcuacugucggaaucccaacaaugagaaagggaaccacggaguuaagggcugggccuucgacgaugggaaugacguguggaugggacgcaccaucuccgaagagagcagaucuggcuaugagacauuuaaagucaucgggggaugguccaccccuaacagcaagcugcagauuaauagacaggugaucgucgauucugacaaccgguccggcuacagcggcauuuucuccguggaagggaaaucuugcaucaaucgcuguuuuuauguugagcucauucggggaagagaacaggagacgcgcgugugguggacaagcaacuccaucgucguguucugcggcaccucugggaccuacggaacaggcagcuggcccgauggggcugacauuaaucugaugcccaucuga

SEQ ID NO: 197535 - RNA, 1410 nt, Artificial Sequence; identical to SEQ ID NO: 197127
  derived and/or modified sequence opt5 from neuraminidase__InfluenzaA__ABB54517

SEQ ID NO: 197536 - RNA, 1410 nt, Artificial Sequence
  derived and/or modified sequence opt5 from neuraminidase__InfluenzaA__ABB59999
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuuccccucuuucuggcagcgcccaacauguugaggaaugcuccuguuauccccgguacccuggggugcgcugcguguguagagacaacuggaagggaagcaaucggcccaucgucgauauuaacaucaaagacuacucuauuguguccagcuauguuugcucuggccuggugggcgacaccccgcgcaagaacgauagcuccucuagcucccacugucucaauccuaacaaugaggaagggggacauggcgucaaagggugggcuuucgacgauggaaacgacguguggaugggcagaacaaucagcgagaaguuucggucuggguacgagaccuucaaaguuaucgaaggaugguccaagcccaauagcaaacugcagauuaaccgccaggugaucgucgauagaggcaaucggucuggcuauuccgggauuuuuagcguggagggaaaguccugcaucaacagauguuucuacgucgaacugauucgcggccggaagcaggagacggaagugugguggacaucuaauagcaucguuaccuuuugcgggaccuccggaacauauggcaccgggucuuggccugacggcgccgauauuaaccucaugcccaucuga

SEQ ID NO: 197537 - RNA, 1410 nt, Artificial Sequence
  derived and/or modified sequence opt5 from neuraminidase__InfluenzaA__ABB60010
augaaccccaaucagaagaucauuaccaucggcagcgugucccugacaauugccacgaucugcuuccucaugcaaauugcuauccuggucaccacaguuacccuucacuuuaaacaguacgaguauucuagcccuccgaacaaucaggugaugcugugugaacccacaaucauugagagaaacaucaccgaaauuguguaccucacaaauaccacgaucgagaaggaaauuugcccuaaacuggccgaguaucggaacugguccaagccccaguguaaaaucaccggguucgcgccuuuuucuaaggacaauagcauucgccuuuccgcuggaggcgauaucugggucacaagagagcccuacgugucuugcgacccugauaaguguuaucaauucgcccuggggcagggaaccacacucaacaaucggcauagcaacgacaccguucacgaucgcacgccguacagaacacugcugaugaaugaacucggcgugcccuuucaucuggggaccaaacaggucugcaucgccugguccucuagcuccugucacgacggaaaggcuuggcuucaugugugcguuacaggccacgaugagaacgccaccgcuagcuucauuuaugacggccggcugguggauucuaucggguccuggagcaaaaagauucuccgcacccaggaaucugagugugucugcaucaauggaacauguacgguggugaugaccgacggcuccgccagcgggagagcggauacaaaaauucuguuuaucgaggaaggaaagaucguccacauuuccccucuuucuggcagcgcccaacauguugaggaaugcuccugcuacccccgguacccuggggugcgcugugugugcagagacaacuggaagggaagcaaucggcccaucgucgauauuaacgugaaagacuauucuaucguuucccgcuacguguguagcggccuggucggcgacaccccgagaaagaacgauucuagcuccucuagccacugccucaauccuaacaaugaggaagggggacauggcgugaaagggugggcuuucgacgauggaaacgacguuuggaugggccggacaauuuccgagaaguuucgcagcggguaugagaccuucaaagugaucgaaggauggucuaagcccaauuccaaacugcagaucaacagacaggucauuguggaucggggcaauagaagcggcuacucugggaucuuuuccgucgagggaaagagcuguauuaaccgcugcuucuauguggaacugauccggggcagaaagcaggagacggaaguuugguggacauccaauucuauuguggucuuuugugggaccagcggaaccuacggcacaggguccuggccugacggcgccgauaucaaccucaugcccauuuga

SEQ ID NO: 197538 - RNA, 1410 nt, Artificial Sequence
  derived and/or modified sequence opt5 from neuraminidase__InfluenzaA__ABB77867
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaacggccauucuaaugacaccguucacgaucggacgccguaucgcacacugcugaugaacgaacucggggugcccuuucaucugggaaccaaacaggucuguaucgccuggagcuccagcucuugccacgacggcaaggcuuggcuucauguguguguuacaggccacgaugagaaugccaccgcuuccuucauuuacgacgggagacugguggauagcaucggaucuugguccaaaaagauucuccggacccaggaaagcgagugcgucuguaucaacggcacaugcacgguggugaugaccgacgggucugccuccggacgcgcggauacaaaaauucuguuuaucgaggaaggcaagaucguccacauuagccaacuuuccgggucugcccagcauguugaggaaugcagcuguuauccuagauaccccggagugcggugcgugugucgcgacaauuggaagggcuccaacagaccuaucgucgauauuaacgugaaagaccacagcaucguuucuuccuacgugugcagcggccuggucggggacacaccccggaagaaugauucuagcuccucuagccauugucucaacccgaauaacgaggaaggaggccacggggugaaaggaugggcuuucgacgauggcaaugacguuuggauggggcgcaccauuuccgagaagcugagaagcggauaugagaccuuuaaagugaucgaaggcuggucuaagccuaacuccaaacugcagaucaaucggcaggucauuguggaucgcggcaacagaagcggguacucuggaaucuucuccgucgagggcaagagcugcauuaaucgguguuuuuauguggaacucaucagagggcgcaagcaagagacggaaguuugguggacauccaacucuauuguggucuucugcggaaccagcggcaccuacgggacaggcuccuggcccgacggagccgauaucaaucugaugccuauuuga

SEQ ID NO: 197539 - RNA, 1410 nt, Artificial Sequence; identical to SEQ ID NO: 197538
  derived and/or modified sequence opt5 from neuraminidase__InfluenzaA__ABB79719

SEQ ID NO: 197540 - RNA, 1410 nt, Artificial Sequence
  derived and/or modified sequence opt5 from neuraminidase__InfluenzaA__ABB79734
augaaccccaaucagaagaucauuaccaucggcagcgugucccugacacucucuacgauuugcuucuuuaugcaaaucgccauucugaucaccacagucacccuucacuucaaacaguacgaguuuaacagcccuccgaauaaccagguuaugcugugugaacccacaaucauugagagaaauaucaccgaaauuguguaucucacaaacaccacgaucgagaaggaaauuugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaaugauaccguucacgaccggacgccguaucgcacacugcugaugaacgaacucggcgugcccuuucaucuggggaccaagcaggucugcaucgccugguccucuagcuccugucacgauggaaaagccuggcuucaugugugcguuacaggcgacgauaagaaugcuaccgccagcuucauuuacaacggcagacugguggacucuaucgucuccuggagcaaaaagauucuccggacccaggagucugaaugugugugcaucaaugggacauguacgguggucaugaccgauggauccgcuagcggcaaagccgacacaaagauucuguuuaucgaggaggggaagaucguucacaccuccacacuuucuggaagcgcgcaacacguggaagagugcuccugcuauccucgcuaccccggcgugagaugugucugccgggauaacuggaaagggagcaaccgcccuauuguggacaucaauauuaaggacuacucuaucguuuccagcuauguguguucuggacuggucggcgauacccccagaaagaacgacagcuccucuagcucccauugccucgauccgaauaacgaagagggcgggcacggagugaaaggcugggccuucgacgaugggaaugacguuuggaugggacggacgauuagcgaaaaacugcgcucuggcuacgagacauuuaaggugaucgaggggugguccaacccuaauagcaaacugcagaucaacagacaggucauuguggaucggggaaaucgcucuggcuauuccggcaucuucagcgucgaagggaaguccuguauuaacagaugcuuuuacguggagcucauccggggaagaaaggaagagaccgaaguucuguggaccucuaauagcauuguggucuucuguggcacauccgggaccuauggaacaggcucuuggcccgacggggcugauaucaaccuuaugccuauuuga

SEQ ID NO: 197541 - RNA, 1410 nt, Artificial Sequence; identical to SEQ ID NO: 197511
  derived and/or modified sequence opt5 from neuraminidase__InfluenzaA__ABB79791

SEQ ID NO: 197542 - RNA, 1410 nt, Artificial Sequence
  derived and/or modified sequence opt5 from neuraminidase__InfluenzaA__ABB79802
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacaauucacgaccggacccccuaucgcacgcuccugaugaaugaacugggggugccuuuucaucucggaacaaagcaggucuguaucgccugguccuccucuuccugccacgauggcaaagccuggcugcauguguguguuaccggccacgacgagaacgcuacagccagcuucauuuacgaugggagacuuguggacucuaucggauccuggagcaagaauauucugcggacccaggaaucugagugcgucuguaucaacgggaccugcacaguggugaugacggauggcuccgcuagcgagcgcgccgacaccaaaauccucuuuauugaagagggaaagaucguccacauuagcccccugucuggcagcgcgcaacauguugaagagugcuccuguuauccuagauaccccggggugcggugcgugugucgcgauaauuggaagggaagcaacagaccgaucgucgacauuaacgugaaagauuacucuaucguuuccagcuaugugugcucuggccuugucggcgacacaccucggaagaaugaccgcagcuccucuagcuacuguagaaaccccaauaacgaaaaagggucccacggagugaagggcugggccuucgaugacgggaaugauguuuggaugggacggaccaucggcgaggagcugcgcagcggguaugaaacauuuaaagugauuggaggcuggucuaccccuaacuccaagcuccagaucaauagacaggucauuguggacagcggcaaccggucuggguacuccggaaucuucagcgucgagggcaaauccugcauuaauagauguuuuuauguggaacugauccgcgggcgggagcaggaaacgagaguuugguggacaucuaacagcauuguggucuucugcggaaccuccggcaccuacgggacaggcucuuggcccgauggagcugacaucaaucugaugcccaucuga

SEQ ID NO: 197543 - RNA, 1410 nt, Artificial Sequence
  derived and/or modified sequence opt5 from neuraminidase__InfluenzaA__ABB79813
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaagucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccugggaagugcuaccaauucgcccugggacagggcaccacacucaauaaccggcauucuaaugauaccgugcacgaccgcacgccguauagaacacugcugaugaacgaacucgggguccccuuucaucugggaaccaaacagguguguaucgccuggagcuccagcucuugccacgauggcaaggcuuggcuucauguuugugugacaggccacgacgagaaugccaccgcuuccuucaucuacgaugggcggcuggucgacagcauuggaucuugguccaaaaacauccuccgcacccaggaaagcgagugcguguguauuaauggcacaugcacgguggucaugaccgaugggucugccuccgagagagcggacacaaagauccuguuuauugaagagggaaaaaucguucacaucagcccucuuuccggcucugcccaacauguggaagagugcagcuguuauccccgguacccuggggugcgcugcgucuguagagauaacuggaagggauccaaccggcccauuguggacaucaauguuaaggauuacagcauugugucuuccuaugucugcagcggccuggugggcgacaccccgcgcaaaaacgacucuagcuccucuagcuacuguagaaauccuaacaaugaaaaggggucccacggaguuaaaggcugggcuuucgaugacgggaacgauguguggaugggacggacaaucagcgaggagcuccgcucuggcuaugaaaccuuuaaggucauugggggaugguccaaacccaauagcaagcugcagaucaacagacaggugaucgucgaccggggcaauagaucuggcuacuccgggauuuucagcguggagggaaaauccugcaucaaccgcuguuuuuauguugaacugauucggggcagaaagcaggagacggaagugugguggacaucuaauagcaucgucguguucugcgggaccuccggaaccuacggcacagggucuuggccugauggcgccgacauuaaccucaugcccaucuga

SEQ ID NO: 197544 - RNA, 1410 nt, Artificial Sequence; identical to SEQ ID NO: 197543
  derived and/or modified sequence opt5 from neuraminidase__InfluenzaA__ABB79960

SEQ ID NO: 197545 - RNA, 1410 nt, Artificial Sequence; identical to SEQ ID NO: 197543
  derived and/or modified sequence opt5 from neuraminidase__InfluenzaA__ABB79971

SEQ ID NO: 197546 - RNA, 1413 nt, Artificial Sequence
  derived and/or modified sequence opt5 from neuraminidase__InfluenzaA__ABB79982
augaacgccaaucagaagaucauuaccaucggcagcauuuccaucgcuauugggaucaucucucugaugcuccaaauuggaaacaucauuagcaucugggccucccacucuauucagacaggcagccagaaucauacgggggugugcaaccagagaaucauuaccuacgagaauagcacaugggucaaccacaccuauguuaauaucaacaauacaaacgugaucgcgggaaaagacaagaccucugugacacuggcuggcaauagcucccuuuguagcauuucugggugggccaucuacaccaaagauaacuccauucggaucggaagcaagggcgacgucuucgugauucgcgaacccuuuaucucuugcucccaucuggaguguagaacguucuuucucacccaaggcgcccugcuuaaugauaaacacagcaacgggacaguuaaggaccggucuccuuaucgcgcucugauguccugcccgcucggagaagcccccagcccuuacaauuccaaguucgagucuguggcuuggagcgccuccgcgugucaugauggcaugggguggcugaccaucggaauuagcggccccgacaacggggccgucgcugugcugaaauauaacggaaucauuacagaaaccaucaagucuuggaaaaagcagauucucagaacgcaggaguccgagugcguuugugugaauggcagcugcuuuacaaucaugaccgauggcccuucuaacggggccgcuagcuacaaaaucuucaagauugaaaagggaaaagucacaaaguccaucgagcugaaugcccccaacuuucacuaugaagaguguucuugcuacccugacaccggcaccgugaugugugugugccgggauaauuggcacgggagcaaccgcccgugggucuccuucaaucagaaccuugacuaccaaauuggauauaucugcagcggcguuuuuggggauaaucccagaccuaaagacggagagggcucuuguaaccccgugacaguggauggcgcgaauggggucaagggauucuccuacaaauauggcaacgggguguggauuggacggacgaaguccaaucgccugagaaaaggcuuugaaaugaucugggacccuaacggguggaccgacacagauucugacuucuccguuaagcaggauguggucgccauuaccgacuggagcggcuacuccggaucuuuugugcagcaucccgagcucacaggccuggauugcauccggccguguuucuggguugaacuugugcgcgggcugccuaaggagaauaccacgaucuggacaagcggauccucuauuagcuucugcggcgucaacuccgacaccgcuaacuggagcuggcccgauggggccgaacucccuuuuaccaucgacaaauga

SEQ ID NO: 197547 - RNA, 1413 nt, Artificial Sequence; identical to SEQ ID NO: 197475
  derived and/or modified sequence opt5 from neuraminidase__InfluenzaA__ABB79993

SEQ ID NO: 197548 - RNA, 1410 nt, Artificial Sequence
  derived and/or modified sequence opt5 from neuraminidase__InfluenzaA__ABB80004
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuaccguuuccagcuauguguguucuggacuugucggcgauacgcccagaaagaacgacagcuccucuagcucccauugccuggauccgaauaacgaggaaggcgggcacggagugaaaggcugggccuucgacgaugggaaugacguuuggaugggacggacaauuagcgagaagcuccgcucuggcuacgagaccuuuaaagugaucgaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggacaucuaauagcauuguggucuucuguggcaccuccgggacauauggaacgggcucuuggcccgacggggcugauaucaaccugaugccuauuuga

SEQ ID NO: 197549 - RNA, 1410 nt, Artificial Sequence; identical to SEQ ID NO: 197533
  derived and/or modified sequence opt5 from neuraminidase__InfluenzaA__ABB80015

SEQ ID NO: 197550 - RNA, 1410 nt, Artificial Sequence
  derived and/or modified sequence opt5 from neuraminidase__InfluenzaA__ABB80037
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaauaacaccacaaucgagaaggaaauuuguccuaaacucguggaguaccggaauuggagcaagccccagugcaaaaucaccggguucgcgccuuuuuccaaggauaacucuauucgccugagcgcuggaggcgacaucuggguuacgagagagcccuauguguccugugauccugggaagugcuaccaauucgcccuuggacagggcaccacacuggacaauaaacauucuaacgauaccauccacgaccggauuccgcaucgcacacuccugaugaaugaacuggggguccccuuucaccucggaaccagacagguguguaucgccuggagcuccagcucuugccaugauggcaaggcuuggcugcacguuugugugacgggcgacgauaaaaacgccacagcuuccuucauuuaugacgggcggcuugucgauagcaucggaucuuggucccagaauauucugcgcacccaagagagcgaaugcguguguaucaacggcacaugcaccguggucaugaccgacgggucugccuccggcagagcggauacacggauccucuuuauugaggagggaaagaucguucacauuagcccucuguccgggucugcccagcauguggaagagugcagcuguuacccccgcuauccuggagugagaugcaucugucgggacaauuggaaaggcuccaaccgccccgucguggacauuaacguugaagauuacagcaucgacucuuccuacgugugcagcggccuugucggggauacgccgagaaauaacgaccggucuagcaauuccaacugucgcaauccuaacaaugagagaggaaaccacggcgugaaggggugggcuuucgaugacggaaaugauguuuggaugggccggaccaucucuaaggaccugagaagcggguaugaaacauuuaaagugauuggaggcugguccacccccaacagcaagucucagaucaaucgccaggucauuguggauuccgacaaccggagcggcuacucugggaucuucuccgucgagggaaaaagcugcauuaauagauguuuuuauguggagcucauccgcggccgggaacaagagacaagaguuugguggaccuccaacucuauuguggucuucugcgggacgagcggaacauacggcaccggguccuggccugauggcgccgacaucaaucugaugcccaucuga

SEQ ID NO: 197551 - RNA, 1413 nt, Artificial Sequence
  derived and/or modified sequence opt5 from neuraminidase__InfluenzaA__ABB80048
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccguggagcugaaugcuccuaacuuucacuaugaagaguguucuugcuacccggacaccggcaccgugaugugugucugccgggauaauuggcacgggagcaaccgccccuggguuuccuucaaucagaaccuugacuaccaaaucggauauauuugcagcggcguguuuggggauaauccuagacccaaagacggagagggcucuuguaacccugugacagucgauggcgccaauggggugaagggauucuccuacaaauauggcaacgggguuuggaucggacggacgaaguccaaucgccugagaaaaggcuuugaaaugauuugggaccccaacggguggaccgacacagauucugacuucuccgugaagcaggaugucguggcgaucaccgacuggagcggcuacuccggaucuuuuguucagcauccggagcucacaggccuggauugcauucggccuuguuucuggguggaacuuguccgcgggcugcccaaggagaauaccacgaucuggacaagcggauccucuaucagcuucugcggcgugaacggggacaccgccaacugguccuggccugauggagcugaacuccccuuuaccauugacaaauga

SEQ ID NO: 197552 - RNA, 1410 nt, Artificial Sequence
  derived and/or modified sequence opt5 from neuraminidase__InfluenzaA__ABB80084
augaaccccaaucagaagaucauuaccaucggcagcgugucccugacaauugccacgaucugcuuccucaugcaaauugcuauccuggucaccacaguuacccuucacuuuaaacaguacgaguguaacucuccuagcaauaaccaggugaugcugugcgaaccgacaaucauugagagaaauaucaccgaaauuguguaucucacaaacaccacgaucgagaaggaaauuugucccaaacuggccgaguaccggaauugguccaagccucagugcaaaaucaccggguucgcgcccuuuucuaaggacaacagcauucgccuuuccgcuggaggcgauaucugggucacaagagagccuuaugugucuugugaccccgauaagugcuaccaauucgcccuggggcagggaaccacacucaauaacggccauagcaaugacaccguucacgaucggacgccuuaucgcacacugcugaugaacgaacucggggugccguuucaucugggaaccaaacaggucuguaucgccugguccucuagcuccugccacgacggcaaggcuuggcuucauguguguguuacaggccacgaugagaaugccaccgcuagcuucauuuacgacgggagacugguggauucuaucggauccuggagcaaaaagauucuccggacccaggaaucugagugcgucuguaucaacggcacaugcacgguggugaugaccgacggguccgccagcggacgcgcggauacaaaaauucuguuuaucgaggaaggcaagaucguccacauuucccaacuuucugggagcgcccagcauguugaggaaugcuccuguuaucccagauacccuggagugcggugcgugugucgcgacaauuggaagggcagcaacagacccaucgucgauauuaacgugaaagaccacucuaucguuuccagcuacgugugcucuggccuggucggggacaccccucggaagaaugauagcuccucuagcucccauugucucaaccccaauaacgaggaaggaggccacggggugaaaggaugggcuuucgacgauggcaaugacguuuggauggggcgcacaauuagcgagaagcugagaucuggauaugagaccuuuaaagugaucgaaggcugguccaagccgaacagcaaacugcagaucaaucggcaggucauuguggaucgcggcaacagaucuggguacuccggaaucuucagcgucgagggcaaguccugcauuaaucgguguuuuuauguggaacucaucagagggcgcaagcaagagacggaaguuugguggacaucuaacagcauuguggucuucugcggaaccuccggcaccuacgggacaggcucuuggccugacggagccgauaucaaucugaugcccauuuga

SEQ ID NO: 197553 - RNA, 1410 nt, Artificial Sequence; identical to SEQ ID NO: 197538
  derived and/or modified sequence opt5 from neuraminidase__InfluenzaA__ABB80095

SEQ ID NO: 197554 - RNA, 1410 nt, Artificial Sequence; identical to SEQ ID NO: 197538
  derived and/or modified sequence opt5 from neuraminidase__InfluenzaA__ABB80162

SEQ ID NO: 197555 - RNA, 1410 nt, Artificial Sequence; identical to SEQ ID NO: 197538
  derived and/or modified sequence opt5 from neuraminidase__InfluenzaA__ABB80199

SEQ ID NO: 197556 - RNA, 1410 nt, Artificial Sequence
  derived and/or modified sequence opt5 from neuraminidase__InfluenzaA__ABB80210
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuuccccucuuucuggcagcgcccaacauguugaggaaugcuccuguuauccccgguacccuggggugcgcugcguguguagagacaacuggaagggaagcaaucggcccaucgucgauauuaacgugaaagacuacucuaucguuuccagcuaugugugcucuggccuggucggcgacaccccgcgcaagaacgauagcuccucuagcucccacugucucaauccuaacaaugaggaagggggacauggcgugaaagggugggcuuucgacgauggaaacgacguuuggaugggcagaacaauuagcgagaaguuucggucuggguacgagaccuucaaagugaucgaaggaugguccaagcccaauagcaaacugcagaucaaccgccaggucauuguggauagaggcaaucggucuggcuauuccgggaucuuuagcgucgagggaaaguccugcauuaacagauguuucuacguggaacugauccgcggccggaagcaggagacggaaguuugguggacaucuaauagcauuguggucuuuugcgggaccuccggaaccuauggcacagggucuuggccugacggcgccgauaucggacucaugcccauuuga

SEQ ID NO: 197557 - RNA, 1410 nt, Artificial Sequence
  derived and/or modified sequence opt5 from neuraminidase__InfluenzaA__ABB80232
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuugcugccggaggcgauaucugggucacaagagagcccuaugugagcugugacccugauaagugcuaccaauucgcccuggggcagggaaccacacucaauaaccggcauuccaaugacaccguucacgaucgcacgccguauagaacacugcugaugaacgaacucggcgugcccuuucaucuggggaccaaacaggucuguaucgcuuggucuagcuccagcugccacgacggaaaggccuggcuucauguguguguuacaggccacgaugagaaugcuaccgccucuuucauuuacgacggccggcugguggauuccaucgggagcuggucuaaaaagauucuccgcacccaggaauccgagugcgucuguaucaacggaacaugcacgguggugaugaccgacggcagcgcgucugggagagccgauacaaaaauucuguuuaucgaggaaggaaagaucguccacauuucccaacuuagcggcuccgcucagcauguugaggaaugcucuuguuauccucgguaccccggggugcgcugcguguguagagacaauuggaagggaagcaaccggccuaucgucgauauuaacgugaaagacuacuccaucguuagcucuuaugugugcuccggccuggucggcgacacaccccgcaagaaugauagcucuagcuccucucacugucucaacccgaauaacgaggaagggggacauggcgugaaagggugggccuucgacgauggagacgauguuuggaugggcagaaccauuagcgagaagcugcgguccggguacgagaccuuuaaagugaucgaaggauggagcaagccuaauucuaaacugcagaucaaccgccaggucauuguggacagaggcaaucgguccggcuauagcgggaucuucucugucgagggaaaguccugcauuaacagauguuuuuacguggaacucauccgcggccggaagcaagagacggaaguuugguggacaagcaauuccauuguggucuucugcgggaccucuggaaccuauggcacagggagcuggcccgauggcgcugacaucaaccugaugccuauuuga

SEQ ID NO: 197558 - RNA, 1410 nt, Artificial Sequence
  derived and/or modified sequence opt5 from neuraminidase__InfluenzaA__ABB80243
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaacggccauucuaaugacaccguucacgaucggacgccguaucgcacacugcugaugaacgaacucggggugcccuuucaucugggaaccaaacaggucuguaucgccuggagcuccagcucuugccacgacggcaaggcuuggcuucauguguguguuacaggccacgaugagaaugccaccgcuuccuucauuuacgacgggagacugguggauagcaucggaucuugguccaaaaagauucuccggacccaggaaagcgagugcgucuguaucaacggcacaugcacgguggugaugaccgacgggucugccuccggacgcgcggauacaaaaauucuguuuaucgaggaaggcaagaucguccacauuagccaacuuuccgggucugcccagcauguugaggaaugcagcuguuauccuagauaccccggagugcggugcgugugucgcgacaauuggaagggcuccaacagaccuaucgucgauauuaacgugaaagaccacagcaucguuucuuccuacgugugcagcggccuggucggggacacaccccggaagaaugauucuagcuccucuagccauugucucaacccgaauaacgaggaaggaggccacggggugaaaggaugggcuuucgacgauggcaaugacguuuggauggggcgcaccauuuccgagaagcugagaagcggauaugagaccuuuaaagugaucgaaggcuggucuaagccuaacuccaaacugcagaucaaucggcaggucauuguggaucgcggcaacagaagcggguacucuggaaucuucuccgucgagggcaagagcugcauuaaucgguguuuuuauguggaacucaucagagggcgcaagaaagagaacgaaguuugguggacguccaauucuauuguggucuucugcggaacaagcggcaccuacgggaccggcuccuggcccgacggagccgauaucaaccugaugccuauuuga

SEQ ID NO: 197559 - RNA, 1410 nt, Artificial Sequence
  derived and/or modified sequence opt5 from neuraminidase__InfluenzaA__ABB80254
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugggccugacaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaagauucuccgcacccaggaaucugagugcgucuguaucaauggcauuugcacaguggugaugacggauggguccgccagcggcagagcggacaccaaaauccuguuuaucgaggaaggaaagauuguccacaucuccccucuuucugggagcgcccaacauguugaggaaugcuccuguuauccccgguacccuggagugcgcugcguguguagagauaacuggaagggcagcaaucggcccauugucgacaucaacgugaaagauuacucuauuguuuccagcuaugugugcucuggccuggucggggacacaccgcgcaagaacgacagcuccucuagcucccacugucucaauccuaacaaugaggaaggaggccauggggugaaaggaugggcuuucgaugacggcaacgauguuuggauggggagaaccaucagcgagaaguuucggucuggauacgagacauucaaagugaucgaaggcugguccaagcccaauagcaaacugcagauuaaccgccaggucaucguggacagaggcaaucggucuggguauuccggaauuuuuagcgucgagggcaaguccugcaucaacagauguuucuacguggaacugauucgcgggcggaagcaggagaccgaaguuugguggacgucuaauagcaucguggucuuuugcggaacauccggcaccuaugggaccggcucuuggccugauggagccgacauuaaccucaugcccaucuga

SEQ ID NO: 197560 - RNA, 1410 nt, Artificial Sequence; identical to SEQ ID NO: 197151
  derived and/or modified sequence opt5 from neuraminidase__InfluenzaA__ABB80495

SEQ ID NO: 197561 - RNA, 1410 nt, Artificial Sequence; identical to SEQ ID NO: 197538
  derived and/or modified sequence opt5 from neuraminidase__InfluenzaA__ABB80506

SEQ ID NO: 197562 - RNA, 1410 nt, Artificial Sequence; identical to SEQ ID NO: 197538
  derived and/or modified sequence opt5 from neuraminidase__InfluenzaA__ABB80517

SEQ ID NO: 197563 - RNA, 1410 nt, Artificial Sequence; identical to SEQ ID NO: 197538
  derived and/or modified sequence opt5 from neuraminidase__InfluenzaA__ABB80532

SEQ ID NO: 197564 - RNA, 1410 nt, Artificial Sequence
  derived and/or modified sequence opt5 from neuraminidase__InfluenzaA__ABB80644
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaauaaaauucuccgcacccaggaaucugagugcgucuguaucaacggaacaugcacgguggugaugaccgacggcuccgccagcgggagagcggauacaaagauucuguuuaucgaggaaggaaaaaucguccacauuuccccucuuucuggcagcgcccaacauguugaggaaugcuccuguuauccccgguacccuggggugcgcugcguguguagagacaauuggaagggaagcaaccggcccaucgucgauauuaacgugaaggacuacucuaucguuuccagcuaugugugcucuggccuggucggcgacaccccgcgcaaaaaugauagcuccucuagcucccacugucucaacccuaauaacgaggaagggggacauggcgugaaggggugggcuuucgacgauggaaaugacguuuggaugggcagaacaauuagcgagaaauuucggucuggguacgagaccuucaaggugaucgaaggaugguccaaacccaacagcaagcugcagaucaaucgccaggucauuguggauagaggcaaccggucuggcuauuccgggaucuuuagcgucgagggaaaauccugcauuaauagauguuucuacguggaacugauccgcggccggaagcaggagacggaaguuugguggacaucuaacagcauuguggucuuuugcgggaccuccggaaccuauggcacagggucuuggccugacggcgccgauaucaaucucaugcccauuuga

SEQ ID NO: 197565 - RNA, 1410 nt, Artificial Sequence
  derived and/or modified sequence opt5 from neuraminidase__InfluenzaA__ABB80664
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaguccuguuuauugaggaaggaaagaucguucacaucuccccucuuucuggcagcgcccaacauguggaggaaugcuccuguuauccccgguacccuggggugcgcugcgucuguagagacaacuggaagggaagcaaucggcccauuguggauaucaacguuaaagacuacucuauuguguccagcuaugucugcucuggccuggugggcgacaccccgcgcaagaacgauagcuccucuagcucccacugucucaauccuaacaaugaggaagggggacauggcguuaaagggugggcuuucgacgauggaaacgacguguggaugggcagaacaaucagcgagaaguuucggucuggguacgagaccuucaaagucauugaaggaugguccaagcccaauagcaaacugcagaucaaccgccaggugaucgucgauagaggcaaucggucuggcuauuccgggauuuuuagcguggagggaaaguccugcaucaacagauguuucuacguugaacugauucgcggccggaagcaggagacggaagugugguggacaucuaauagcaucgucguguuuugcgggaccuccggaaccuauggcacagggucuuggccugacggcgccgauauuaaccucaugcccaucuga

SEQ ID NO: 197566 - RNA, 1410 nt, Artificial Sequence
  derived and/or modified sequence opt5 from neuraminidase__InfluenzaA__ABB80675
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuugcugccggaggcgauaucugggucacaagagagcccuaugugagcugugacccugauaagugcuaccaauucgcccuggggcagggaaccacacucaauaaccggcauuccaaugacaccguucacgaucgcacgccguauagaacacugcugaugaacgaacucggcgugcccuuucaucuggggaccaaacaggucuguaucgcuuggucuagcuccagcugccacgacggaaaggccuggcuucauguguguguuacaggccacgaugagaaugcuaccgccucuuucauuuacgacggccggcugguggauuccaucgggagcuggucuaaaaagauucuccgcacccaggaauccgagugcgucuguaucaacggaacaugcacgguggugaugaccgacggcagcgcgucugggagagccgauacaaaaauucuguuuaucgaggaaggaaagaucguccacauuucccaacuuagcggcuccgcucagcauguugaggaaugcucuuguuauccucgguaccccggggugcgcugcguguguagagacaauuggaagggaagcaaccggccuaucgucgauauuaacgugaaagacuacuccaucguuagcucuuaugugugcuccggccuggucggcgacacaccccgcaagaaugauagcucuagcuccucuuacugucucaacccgaauaacgaggaagggggacacggcgugaaagggugggccuucgacgauggagacgauguuuggaugggcagaaccauuagcgagaagcugcgguccggguaugagaccuuuaaagugaucgaaggauggagcaagccuaauucuaaacugcagaucaaccgccaggucauuguggacagaggcaaucgguccggcuacagcgggaucuucucugucgagggaaaguccugcauuaacagauguuuuuauguggaacucauccgcggccggaagcaagagacggaaguuugguggacaagcaauuccauuguggucuucugcgggaccucuggaaccuacggcacagggagcuggcccgauggcgcugacaucaaccugaugccuauuuga

SEQ ID NO: 197567 - RNA, 1410 nt, Artificial Sequence
  derived and/or modified sequence opt5 from neuraminidase__InfluenzaA__ABB80685
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugauaagugcuaccaauucgcccuggggcagggaacaacccucaauaacggccauucuaaugacacaguucacgaucggaccccguaucgcacgcugcugaugaacgaacucggggugcccuuucaucugggaacaaaacaggucuguauugccuggagcuccagcucuugccacgacggcaaggcuuggcuucauguguguguuaccggccacgaugagaaugccacagcuuccuucaucuacgacgggagacugguggauagcauuggaucuugguccaaaaagauccuccggacccaggaaagcgagugcgucuguauuaacgggaccugcacaguggugaugacggacggcucugccuccggacgcgcggauaccaaaauccuguuuaucgaggaaggcaagauuguccacaucagccaacuuuccgggucugcccagcauguugaggaaugcagcuguuauccuagauaccccggagugcggugcgugugucgcgacaauuggaagggcuccaacagaccuauugucgauaucaacgugaaagaccacagcauuguuucuuccuacgugugcagcggccuggucggggacacaccccggaagaaugauucuagcuccucuagccauugucucaacccgaauaacgaggaaggaggccacggggugaaaggaugggcuuucgacgauggcaaugacguuuggauggggcgcaccaucuccgagaagcugagaagcggauaugagacauuuaaagugaucgaaggcuggucuaagccuaacuccaaacugcagauuaaucggcaggucaucguggaucgcggcaacagaagcggguacucuggaauuuucuccgucgagggcaagagcugcaucaaucgguguuuuuauguggaacucauuagagggcgcaagcaagagaccgaaguuugguggacguccaacucuaucguggucuucugcggaacaagcggcaccuacgggaccggcuccuggcccgacggagccgauauuaaucugaugccuaucuga

SEQ ID NO: 197568 - RNA, 1410 nt, Artificial Sequence; identical to SEQ ID NO: 197538
  derived and/or modified sequence opt5 from neuraminidase__InfluenzaA__ABB80696

SEQ ID NO: 197569 - RNA, 1410 nt, Artificial Sequence
  derived and/or modified sequence opt5 from neuraminidase__InfluenzaA__ABB80707
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugggccugacaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaagauucuccgcacccaggaaucugagugcgucuguaucaauggcacaugcacgguggugaugaccgauggguccgccagcggcagagcggacacaaaaauucuguuuaucgaggaaggaaagaucguccacauuuccccucuuucugggagcgcccaacauguugaggaaugcuccuguuauccccgguacccuggagugcgcugcguguguagagauaacuggaagggcagcaaucggcccaucgucgacauuaacgugaaagauuacucuaucguuuccagcuaugugugcucuggccuggucggggacaccccgcgcaagaacgacagcuccucuagcucccacugucucaauccuaacaaugaggaaggaggccauggggugaaaggaugggcuuucgaugacggcaacgauguuuggauggggagaacaauuagcgagaaguuucggucuggauacgagaccuucaaagugaucgaaggcugguccaagcccaauagcaaacugcagaucaaccgccaggucauuguggacagaggcaaucggucuggguauuccggaaucuuuagcgucgagggcaaguccugcauuaacagauguuucuacguggaacugauccgcgggcggaagcaggagacggaaguuugguggacaucuaauagcauuguggucuuuugcggaaccuccggcaccuaugggacaggcucuuggccugauggagccgacaucaaccucaugcccauuuga

SEQ ID NO: 197570 - RNA, 1410 nt, Artificial Sequence; identical to SEQ ID NO: 197538
  derived and/or modified sequence opt5 from neuraminidase__InfluenzaA__ABB80716

SEQ ID NO: 197571 - RNA, 1410 nt, Artificial Sequence
  derived and/or modified sequence opt5 from neuraminidase__InfluenzaA__ABB80725
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacagugaucgagagaaacauuaccgaaaucgucuaucucacaaauaccacgauugagaaggaaaucuguccuaaacuggccgaguaccggaacugguccaagccccagugcaaaauuaccggguucgcgccuuuuucuaaggacaauagcauccgccuuuccgcuggaggcgauauuugggugacaagagagcccuauguuucuugugacccugauaagugcuaccaauucgcccuggggcagggaaccacacucaacaaucggcauagcaacgacaccgugcacgaucgcacgccguauagaacacugcugaugaaugaacucggcguccccuuucaucuggggaccaaacagguguguaucgccugguccucuagcuccugccacgacggaaaggcuuggcuucauguuugugugacaggccacgaugagaacgccaccgcuagcuucaucuacgacggccggcuggucgauucuauuggguccuggagcaaaaagauccuccgcacccaggaaucugagugcguguguauuaauggaacaugcacgguggucaugaccgacggcuccgccagcgggagagcggauacaaaaauccuguuuauugaggaaggaaagaucguucacaucuccccucuuucuggcagcgcccaacauguggaggaaugcuccuguuauccccgguacccuggggugcgcugcgucuguagagacaacuggaagggaagcaaucggcccauuguggauaucaacguuaaagacuacucuauuguguccagcuaugucugcucuggccuggugggcgacaccccgcgcaagaacgauagcuccucuagcucccacugucucaauccuaacaaugaggaagggggacauggcguuaaagggugggcuuucgacgauggaaacgacguguggaugggcagaacaaucagcgagaaguuucggucuggguacgagaccuucaaagucauugaaggaugguccaagcccaauagcaaacugcagaucaaccgccaggugaucgucgauagaggcaaucggucuggcuauuccgggauuuuuagcguggagggaaaguccugcaucaacagauguuucuacguugaacugauucgcggccggaagcaggagacggaagugugguggacaucuaauagcaucgucgccuuuugcgggaccuccggaaccuauggcacagggucuuggccugacggcgcugauauuaaccucaugcccaucuga

SEQ ID NO: 197572 - RNA, 1410 nt, Artificial Sequence
  derived and/or modified sequence opt5 from neuraminidase__InfluenzaA__ABB80740
augaaccccaaucagaagaucauuaccaucggcagcgugucccugacaauugccacgaucugcuuccucaugcaaauugcuauccuggucaccacaguuacccuucacuuuaaacaguacgaguguugcucuccuccgaacaaucaggugaugcugugugaacccacaaucauugagagaaacaucaccgaaauuguguaucucacaaauaccacgaucgagaaggaaauuugcccuaaacuggccgaguaccggaacuggagcaagccccaguguaaaaucaccggguucgcgccuuuuuccaaggacaauucuauucgccuuagcgcuggaggcgauaucugggucacaagagagcccuauguguccugcgacccugauaaguguuaccaauucgcccuggggcagggaaccacacucaacaaucggcauucuaacgacaccguucacgaucgcacgccguauagaacacugcugaugaaugaacucggcgugcccuuucaucuggggaccaaacaggucugcaucgccuggagcuccagcucuugucacgacggaaaggcuuggcuucaugugugcguuacaggccacgaugagaacgccaccgcuuccuucauuuacgacggccggcugguggauagcaucgggucuugguccaaaaagauucuccgcacccaggaaagcgagugugucugcaucaauggaacaugcacgguggugaugaccgacggcucugccuccgggagagcggauacaaaaauucuguuuaucgaggaaggaaagaucguccacauuagcccucuuuccggcucugcccaacauguugaggaauguagcugcuauccccgguacccuggggugcgcugugugugcagagacaacuggaagggauccaaucggcccaucgucgauauuaacgugaaagacuacagcaucguuucuuccuauguguguagcggccuggucggcgacaccccgcgcaagaacgauucuagcuccucuagccacugccucaauccuaacaaugaggaagggggacauggcgugaaagggugggcuuucgacgauggaaacgacguuuggaugggcagaacaauuuccgagaaguuucggagcggguacgagaccuucaaagugaucgaaggauggucuaagcccaauuccaaacugcagaucaaccgccaggucauuguggauagaggcaaucggagcggcuauucugggaucuuuuccgucgagggaaagagcuguauuaacagaugcuucuacguggaacugauccgcggccggaagcaggagacggaaguuugguggacauccaauucuauuguggccuuuugugggaccagcggaaccuauggcacaggguccuggccugacggcgcugauaucaaccucaugcccauuuga

SEQ ID NO: 197573 - RNA, 1410 nt, Artificial Sequence; identical to SEQ ID NO: 197538
  derived and/or modified sequence opt5 from neuraminidase__InfluenzaA__ABB80751

SEQ ID NO: 197574 - RNA, 1410 nt, Artificial Sequence; identical to SEQ ID NO: 197257
  derived and/or modified sequence opt5 from neuraminidase__InfluenzaA__ABB82186

SEQ ID NO: 197575 - RNA, 1413 nt, Artificial Sequence; identical to SEQ ID NO: 197420
  derived and/or modified sequence opt5 from neuraminidase__InfluenzaA__ABB82197

SEQ ID NO: 197576 - RNA, 1413 nt, Artificial Sequence; identical to SEQ ID NO: 197410
  derived and/or modified sequence opt5 from neuraminidase__InfluenzaA__ABB82208

SEQ ID NO: 197577 - RNA, 1413 nt, Artificial Sequence
  derived and/or modified sequence opt5 from neuraminidase__InfluenzaA__ABB82219
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuauugccgaaaaagacaagaccucugugacacuggcgggaaauagcucccuuuguagcaucucuggcugggcuauuuacaccaaagauaacuccauccggauugggagcaagggagacguguucgucauccgcgagccuuuuaucucuugcuccaaucuggaauguagaacguucuuucucacccaaggcgcccugcuuaacgauaaacauagcaauggcacagugaaggaccggucuccguaucgcgcccugauguccugcccccucggggaggcuccuagccccuacaacuccaaguucgaaucuguugccuggagcgcuuccgccugucacgauggaaugggcuggcugaccauugggaucagcggaccugacaacggcgcgguggccguccugaaauauaaugggauuaucacagagaccauuaagucuuggaaaaagagaauccuccggacgcaggaguccgaaugcguguguguuaacggaagcugcuuuacaaucaugaccgauggccccucuaauggcgcugccagcuacaaaauuuucaagaucgagaaggggaaagugacaaaguccauugaacugaacgcuccuaauuuucauuaugaggaguguucuugcuacccggacaccggaaccgucaugugugugugccgcgauaacuggcacggcagcaauagacccuggguguccuucaaccagaaucuugacuaccagaucggguauauuugcagcggagucuuuggcgauaacccucggcccaaagacggggaaggaucuuguaauccuguuacaguggauggcgccgacggcgugaagggguucuccuacaaauauggaaacggcgucuggaucgggcgcacgaaguccaauagacugcggaaaggauuugagaugauuugggaccccaacggcuggaccgauacagacucugauuucuccgugaagcaagacguuguggcgaucaccgauuggagcggguacuccggcucuuuuguccagcacccggaacucacaggacuggacugcauccgcccuuguuucuggguggagcuuguuagaggccugccccgggaaaauaccacgauuuggacaagcggguccucuaucagcuucugcggagugaacuccgaugccgcugacuggagcuggccugauggcgccgagcuccccuuuaccauugacaaguga

SEQ ID NO: 197578 - RNA, 1410 nt, Artificial Sequence
  derived and/or modified sequence opt5 from neuraminidase__InfluenzaA__ABB82230
augaaccccaaucagaagaucauuaccaucggcagcgugucccugacaauugccacggucugcuuccucaugcaaaucgcuauucugguuaccacagugacccuucacuuuaaacaguacgagugugacucuccugccaacaaucaggugaugccgugcgaacccaucaucauugagagaaacaucacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggauuccgcaucgcacccuccugaugaacgaacuggggguccccuuucaccucggaacgagacagguguguaucgccuggagcuccagcucuugccaugauggcaaggcuuggcugcacguuugugugacaggcgacgauaaaaaugccaccgcuuccuucauuuaugacgggcggcuugucgauagcaucggaucuuggucccagaacauucugcgcacacaagagagcgaaugcguguguaucaauggaaccugcaccguggucaugacagacgggucugccuccggcagagcggauacgcggauccucuuuauugaggagggcaagaucguucacauuagcccucuguccgggucugcccagcauguggaagagugcagcuguuacccccgcuauccuggagugagaugcaucugucgggacaacuggaaaggcuccaaucgccccauugucgacaucaacgugaaggauuacagcaucgacucuagauacguuugcuccggccuugugggggauaccccgcggaacaaugaccgcagcucuaacagcaauuguagaaacccuaauaacgauaagggaaaucacggcgucaaagggugggcuuucgacgauggaaacgacguguggaugggccggacaauuuccaaggauucuagaagcggguaugaaaccuuuaaaguuaucggaggcugguccacacccaauagcaagucucagauuaaccgccaggugaucgucgacuccgauaaucggagcggcuacucugggauuuucuccguggagggaaaaagcugcaucaacagauguuuuuaugucgaacugauucgcggccgggagcaagagaccagagugugguggacguccaauucuaucguuguguucugcgggacaagcggaaccuacggcaccggguccuggccugacggcgccgacaucaaccucaugcccauuuga

SEQ ID NO: 197579 - RNA, 1410 nt, Artificial Sequence
  derived and/or modified sequence opt5 from neuraminidase__InfluenzaA__ABB83018
augaaccccaaucagaagaucauuaccaucggcagcgugucccugacaauugccacgaucugcuuccucacccaaauugcuauccuggucacaaccguuacacuucacuuuaaacaguacggguguaacucuccuccgaauaaccaggugaugcugugcgagcccaccaucauugaaagaaauaucacagagauuguguaucucaccaacacgaccaucgaaaaggagauuuguccuaaacuggccgaauaccggaauuggagcaagccccagugcaacaucacaggauucgcgccuuuuuccaaagacaauucuauucgccuuagcgcuggcggggauaucugggucaccagagagcccuauguguccugugacccugauaagugcuaccaauucgcccugggacagggcacaacccucaacaaugggcauucuaacgacacgguucacgaucggacaccguaucgcacccugcugaugaaugagcucggagugcccuuucaucugggcacaaagcaggucuguaucgccuggagcuccagcucuugccacgacggcaaggcuuggcuucauguguguguuaccggggaugacaagaacgccaccgcuuccuucauuuacaauggaagacugguggauagcaucggcucuugguccaaaaagauucuccggacacaggaaagcgagugcgucuguaucaacgggacgugcaccguggugaugacagacggaucugccuccggcaaagcggauaccaagauucuguuuaucgaagaggggaagaucguccacacaagccuucuguccggaucugcccaacacguugaggaaugcagcuguuauccucgcuaccccggcgugagaugcgugugucgggacaacuggaaaggcuccaaucgcccuauugucgauaucaacgugaaggacuacagcauuguuucuuccuaugugugcagcgggcucgucggagacacccccagaaagaaugauucuagcuccucuagccauugucuggacccgaacaaugaggaaggcgggcacggagugaaaggcugggcuuucgaugacgggaacgauguuuggaugggacggacgaucuccgagaaacugcgcagcggcuacgaaacauuuaaggugauugagggcuggucuaaaccuaauuccaagcuccagaucaacagacaggucaucguggaccgggggaaucgcagcggauauucuggcauuuucuccgucgaggggaaaagcugcaucaacagauguuuuuacguggaacugauucggggaagaaaucaggagaccgaaguucuuuggaccuccaacucuaucguggucuucugcggcacaagcgggaccuauggcacaggauccuggcccgauggcgccgacauuaaucugaugccuaucuga

SEQ ID NO: 197580 - RNA, 1410 nt, Artificial Sequence; identical to SEQ ID NO: 197579
  derived and/or modified sequence opt5 from neuraminidase__InfluenzaA__ABB83029

SEQ ID NO: 197581 - RNA, 1410 nt, Artificial Sequence; identical to SEQ ID NO: 197406
  derived and/or modified sequence opt5 from neuraminidase__InfluenzaA__ABB83130

SEQ ID NO: 197582 - RNA, 1410 nt, Artificial Sequence
  derived and/or modified sequence opt5 from neuraminidase__InfluenzaA__ABB83141
augaaccccaaucagaagaucauuaccaucggcagcgugucccugacaauugccacgaucugcuuccucucucaaauugcuauccuggucaccacaguuacccuucacuuuaaacaguacgaguguaacagcccuccgaauaaccaggugaugcugugcgaacccacaaucauugagagaaauaucaccgaaauuguguaucucacaaacaccacgaucgagaaggaaauuuguccuaaacuggccgaguaccggaauugguccaagccccagugcaacaucaccggguucgcgccuuuuucuaaagacaauagcauucgccuuuccgcuggaggcgauaucugggucacaagagagcccuaugugucuugugacccugauaagugcuaccaauucgcccuggggcagggaaccacacucaacaauggccauagcaacgacaccguucacgaucggacgccguaucgcacacugcugaugaaugaacucggggugcccuuucaucugggaaccaagcaggucuguaucgccugguccucuagcuccugccacgacggcaaggcuuggcuucauguguguguuacaggcgaugacaaaaacgccaccgcuagcuucauuuacaaugggagacugguggauucuaucggauccuggagcaaaaagauucuccggacccaggagucugaaugcgucuguaucaacggcacaugcacgguggugaugaccgacggguccgccagcggaaaagcggauacaaagauucuguuuaucgaggagggcaagaucguccacaccucccuucugucugggagcgcccaacacguugaagagugcuccuguuauccucgcuaccccggagugagaugcgugugucgggacaacuggaaaggcagcaaucgcccuauugucgauaucaacgugaaggacuacucuauuguuuccagcuaugugugcucuggccucgucggggacacaccccggaaaaaugauagcuccucuagcucccauugucuggacccgaacaaugaagagggaggccacggggugaagggaugggcuuucgaugacggcaacgauguuuggauggggagaaccaucagcgaaaaacugcgcucuggauacgagacguuuaaggugauugagggcugguccaaaccuaauagcaagcuccagaucaacagacaggucaucguggaccgggauaaucgcucuggcuauuccgggauuuucagcgucgaaggaaaguccugcaucaacagauguuuuuacguggagcugauucggggcagaaaucaggaaacagagguucuuuggaccucuaacagcaucguggucuucugcgggaccuccggaacauauggcaccgggucuuggcccgacggcgccgauauuaaucugaugccuaucuga

SEQ ID NO: 197583 - RNA, 1410 nt, Artificial Sequence
  derived and/or modified sequence opt5 from neuraminidase__InfluenzaA__ABB86876
augaacaccaaucagagaaucauuacaaucggcacggugugccugauugucgggaucauuagccuccugcuucaaaucggaaacaucguuucccuguggauuucucacagcauccagaccggcgggaagaaucauuccgagauguguaaccagaaugugauuacauacgugaacaauaccugggucaaccggacauaugugaauaucucuaacaccaauauugccacaguucaggacgugaccagcgucauccucgcuggaaacuccucucugugcagcguguccggcugggccauuuacagcaaagauaauucuauccgcaucggguccaagggagacauuuucguuaucagagaacccuuuauuagcuguucucaccuugagugccggacguucuuucugacccaaggcgcgcuccugaacgauaaacauuccaauggcacagugaaggaccgcagcccuuauagaacccugaugucuuguccgaucggggaagcucccuccccuuacaacagccgguucgaguccgucgccuggucugccagcgcuugccacgauggaaugggcuggcucacaauugggaucuccggacccgacaacggcgccguggcugugcugaaauauaaugggaucauuaccgauacgaucaagagcuggcgcaacaagauucuuagaacacaggaaucugagugugucugcaugaauggauccuguuuuaccguucugacagacggcccuagcaacggccaggccucuuacaaaaucuucaagguggagaaagggaagauuaucaaaagcaucgaacucgaugcgcccaauuaucauuacgaggaaugcuccuguuacccugacaccggaaaggugaugugcgucugccgggauaacuggcacgccucuaaucgcccgugggugagcuuugaccagaaccuggauuaucaaauuggcuacaucuguuccgggguuuucggagacaaucccagaagcaacgacggcaaggggaauugcggaccugugcuuucuaacggcgcuaauggcgucaaaggguuuuccuuccgguauggaaacggcguguggauugggcgcaccaagagcaucaauucuagauccggauuugagaugauuugggaucccaacggcuggacagggacggacagcuccuucucuaugaaacaggauaucauugcccugaccgacuggagcggcuacuccggaucuuuuguucagcacccugagcucacaggcaugaacuguauccggcccugcuucuggguggaacugauccgcgggcagccgaaggagagcaccauuugggcuuccggaagcucuaucuccuucuguggcgucgauagcgaaacaaccucuugguccuggccugacggggccgaucugcccuuuacgauugacaaauga

SEQ ID NO: 197584 - RNA, 1410 nt, Artificial Sequence
  derived and/or modified sequence opt5 from neuraminidase__InfluenzaA__ABB86886
augaacaccaaucagagaaucauuacaaucggcacggccugccuggcuauugggaucgugagccuccugcuucaaauuggaaacaucgucucccuguggaucucucacagcauucagaccgaggaaaagaaucauuccgagacauguucucagaacuucaucacccacgaaaauaacacauggguuaaucagaccuacauuaacaucagcaauacaaacaauguggugggccaaggggucaccuccauuaugcucgccggaaacucuagccugugccccaucuccggcugggcgauuuauagcaaagacaauucuauccggaucggguccaagggagauauuuuugugauccgcgagccuuucauuagcuguucucaucuugaaugcagaacguuuuuccugacccagggcgcucuccugaacgacaaacacuccaauggcacaguuaaggaucggagcccguaccgcacccugaugucuugucccaucggggaggccccuucccccuauaacagcagauuugaguccguggccuggucugcuagcgccugccaugacggaaugggcuggcucacaauugggaucuccggaccugauaacggcgcugucgccguguucaaauacaaugggaucauuaccgacacgaucaagagcuggcggaacaagauucugcgcacacaggaaucugaguguguuugcaucaauggauccuguuuuaccauuaugacagauggccccagcaacggccaggcgucuuauaaaaucuucaagauggaaaaagggaagaucauuaaaagcguggagcuugacgccccuaauuaccacuaugaggaauccucuugcuacccggauaccggaaaggucgugugugugugcagagacaacuggcacgcuagcaaucggcccugggucuccuuugaucaaaaccuggacuaccagaucggcuauauuugcagcgggguuuucggagauaauccucgcucuaacgacggcaaggggaauuguggacccgugcucuccaacggcgccaauggcgugaaagaggucagcuuuagauacgggaacggaguguggaucggccggaccaagucuauuuccagccgcuccggguucgaaaugaucugggacccuaauggauggacagagacggauucuagcuuuuccauuaaacaggacaucaucgcucugaccgauuggucuggcuauagcggguccuucguucagcaucccgaacuuacaggcaugaacugcauuaagccguguuucuggguggagcugaucagaggacaaccuaaagagagcaccauuuggacaucuggcuccagcaucucuuuuugcggggucgacuccgaaaccgccagcuggucuuggcccgauggagcggaccucccuuucacgauugauaaguga

SEQ ID NO: 197585 - RNA, 1410 nt, Artificial Sequence
  derived and/or modified sequence opt5 from neuraminidase__InfluenzaA__ABB86898
augaaccccaaucagaagaucauuaccaucggcagcgugucccugacacucgccacgauuugcuuccugaugcaaaucgcuauucuugucaccacaguuacccugcacuuuaaacagcaggaguguaacucuccuccgaauaaccaggugaugcucugcgaacccacaaucaucgagagaaauauuaccgaaaucguguaccugacaaacaccacgauugagaaggaaaucuguccuaaacuugccgaguaucggaauuggagcaagccccaaugcaacauuaccggguucgcgccuuuuuccaaagacaauucuauccgccugagcgcuggaggcgauauuugggucacaagagagcccuacguguccugugacccugauaagugcuaucaguucgcccucgggcagggaaccacacugaacaauggccauucuaacaauaccguucacgaccggacgccguaccgcacacugcucaugaacgaacugggggugcccuuucaucuuggaaccagacaggucuguaucgccuggagcuccagcucuugccacgauggcaaggcuuggcugcauguguguaucacaggcgacgauaaaaaugccaccgcuuccuucauuuauaacgggcggcucguugacagcaucggaucuugguccaagaaaauucugcgcacccaagagagcgaaugcguguguaucaacggcacaugcacggucgugaugaccgaugggucugccuccggaaaggcggacacaaaaauucuuuuuaucgaggagggcaagaucgugcacauuagcacccuguccgggucugcccagcacgucgaagagugcagcuguuacccuagauaucccggaguucggugcgugugucgcgauaauuggaagggcuccaacagaccuaucguggacauuaaugucaaagauuacagcaucgugucuuccuacguuugcagcggccucgugggggacacaccccggaagaacgacucuuucagcuccucucauugucuggauccgaauaacgaagagggaggccacggggucaaaggaugggcuuuugacgauggcaaugacguguggauggggcgcaccauuagcgaaaagcugagauccggauaugagacguucaaaguuaucgagggcuggagcaagccuaacucuaaacuccagaucaaucgccaggugauugucgaacggggcuccagaagcggguacucuggaaucuuuuccguggagggcaagagcugcauuaaccgguguuucuaugucgaacugaucagagggcgcaaggaggaaacaaaagugugguggaccuccaauucuauuguuguguuuugcggaaccagcggcacauacgggaccggcuccuggcccgauggagccgacaucaaccuuaugccuauuuga

SEQ ID NO: 197586 - RNA, 1410 nt, Artificial Sequence
  derived and/or modified sequence opt5 from neuraminidase__InfluenzaA__ABB86906
augaacaccaaucagagaaucauuacaaucggcacggugugccugauugucgggaucauuagccuccugcuucaaaucggaaacaucguuucccuguggauuucucacagcauccagaccggcgggaagaaucauuccgagauguguaaccagaaugugauuacauacgugaacaauaccugggucaaccggacauaugugaauaucucuaacaccaauauugccacaguucaggacgugaccagcgucauccucgcuggaaacuccucucugugcagcguguccggcugggccauuuacagcaaagauaauucuauccgcaucggguccaagggagacauuuucguuaucagagaacccuuuauuagcuguucucaccuugagugccggacguucuuucugacccaaggcgcgcuccugaacgauaaacauuccaauggcacagugaaggaccgcagcccuuauagaacccugaugucuuguccgaucggggaagcucccuccccuuacaacagccgguucgaguccgucgccuggucugccagcgcuugccacgauggaaugggcuggcucacaauugggaucuccggacccgacaacggcgccguggcugugcugaaauauaaugggaucauuaccgauacgaucaagagcuggcgcaacaagauucuuagaacacaggaaucugagugugucugcaugaauggauccuguuuuaccguucugacagacggcccuagcaacggccaggccucuuacgagaucuucaaaguggaaaaggggaaaauuaucaagagcaucgagcucgaugcgcccaauuaucauuacgaagagugcuccuguuacccugacaccggaaaagugaugugcgucugccgggauaacuggcacgccucuaaucgcccgugggugagcuuugaccagaaccugaauuaucaaauuggcuacaucuguuccgggguuuucggagauaaccccagaagcaaugacggcaaggggaacugcggaccugugcuuucuaauggcgcuaacggcgucaagggguuuuccuuccgguauggaaauggcguguggauugggcgcaccaaaagcaucucuuccagaagcggauuugagaugguuugggaccccaacggcuggacagggacggauucccgguucucuaugaagcaggacauuaucgcccugaccgauuggagcggcuacuccggaucuuuugugcagcacccugaacucacaggcaugaacuguauucgccccugcuucugggucgagcugaucagagggcagccgaaagaaagcaccaucugggcuuccggaagcucuauuuccuucuguggcgugaauagcgagacagccucuugguccuggccugacggggcggaucugcccuuuaccaucgacaaguga

SEQ ID NO: 197587 - RNA, 1410 nt, Artificial Sequence
  derived and/or modified sequence opt5 from neuraminidase__InfluenzaA__ABB86916
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguauuaccggcgaugacaaaaacgccaccgcuuccuucaucuacaaugggagacugguugauagcauuucuuccuggagcaaaaagauccuccggacacaggagucugaaugcguguguauuaacggaacgugcaccgucgugaugacagacggcuccgccagcgggaaagcggauaccaagauccuguuuaucgaggagggaaagauugugcacacaucccuucugucuggcagcgcccaacacgucgaagagugcuccuguuauccucgcuaccccgggguuagaugcgugugucgggacaacuggaaaggaagcaaucgcccuaucguggauauuaacgucaaggacuacucuaucguguccagcuauguuugcucuggccucgugggcgacacccccagaaagaaugauagcuccucuagcucccauugucuggacccgaacaaugaagaagggggacacggcgucaaagggugggcuuucgaugacggaaacgauguguggaugggccggacgauuagcgagaaacugcgcucuggguacgagacauuuaagguuaucgagggaugguccaaaccuaauagcaagcuccagaucaacagacaggugauugucgaccgggauaaucgcucuggcuauuccggcaucuucagcguggaagggaaguccugcauuaacagauguuuuuacgucgagcugauccggggaagaaaucaggaaaccgaggugcuuuggaccucuaacagcauuguuguguucugcggcacauccgggaccuauggaacaggcucuuggcccgacggggccgauaucaaucugaugccuauuuga

SEQ ID NO: 197588 - RNA, 1410 nt, Artificial Sequence
  derived and/or modified sequence opt5 from neuraminidase__InfluenzaA__ABB86928
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguauuacaggcgaugacaaaaacgccaccgcuuccuucaucuacaaugggcggcugguugauagcauuggaucuugguccaagaaaauccuccgcacccaggagagcgaaugcguguguauuaacggcacaugcacggucgugaugaccgacgggucugccuccggaaaggcggauacaaaaauccuguuuaucgaggagggcaagauugugcacaucagcacccuuuccgggucugcccaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacaccccggaagaaugauucuuucagcuccucucauugucucaacccgaauaacgaagagggaggccacggggucaaaggaugggcuuuugacgauggcaaugacguguggauggggcgcaccaucagcgaaaagcugagauccggauacgagacguucaaaguuaucgagggcuggagcaagccuaacucuaaacugcagauuaaucggcagguuaucgucgaacgcggcaacagauccggguauagcggaaucuuuucuauugagggcaaguccugcauuaaucgguguuucuacguggaacucaucagagggcgcaaggaggaaacaaaagucugguggaccagcaacuccauugugguguuuugcggaaccucuggcacauaugggaccggcagcuggcccgauggagccgacaucaaucugaugccuaucuga

SEQ ID NO: 197589 - RNA, 1410 nt, Artificial Sequence
  derived and/or modified sequence opt5 from neuraminidase__InfluenzaA__ABB86936
augaacaccaaucagagaaucauuacaaucggcacggugugccugauugucgggaucauuagccuccugcuucaaaucggaaacaucguuucccuguggauuaaucacucuauccagaccgagggcaagaaccauagcgaaauguguaaucagaacgugauuacauacgugaauaacaccugggucaaucggacauaugugaacaucuccaauaccaacauugccacaguucaggacgugaccucugucauccucgcugggaauagcucccugugccccgugucuggaugggccauuuacagcaaagauaacuccauccgcaucggcagcaagggggacauuuucguuaucagagagccuuuuauuucuuguucccaccuugaaugccggacguucuuucugacccaaggagcgcuccugaaugauaaacauagcaacggcacagugcgcgacagaucuccguaucggacccugauguccugucccacaggcgaggcuccuagccccuacaacucucgcuucgaauccgucgccuggagcgccuccgcuugccacgaugggaugggauggcucaccaucggcauuucugggccugacaauggagccguggcugugcugaaguauaacggcaucaucacggauacaauuaaaagcuggagaaauaagauccuucggacccaggaguccgagugugucugcaugaacgggagcuguuuuacaguucugaccgacggacccucuaauggccaggccuccuacaagauuuucaaaguggaaaagggcaaaaucauuaagagcaucgagcucgaugcgccuaacuaucauuacgaagagugcucuuguuacccggacaccgggaaagugaugugcgucugccgcgauaauuggcacgccagcaacagacccuggaucuauuuugaccagaaucuggauuaccaaauuggauauaucuguuccggcguguucggggacaacccucggucuaaugacggaaagggcaacugcgggcccguucuuagcaauggagcuaacggcgugaagggcuuuuccuuccgcuacgggaauggagucuggauuggcagaacaaaaagcaucaacucucgguccggguuugagaugauuugggauccuaacggauggacgggcaccgacagcucuuucuccaugaagcaggauauccuggccacaaccgacuggagcggguauuccggcucuuuugugcagcaccccgaacucacaggaaugaauuguauucgcccgugcuucuggguugagcugaucagaggccagccuaaagaaagcaccaucugggcuuccgggucuagcauuuccuucuguggagugaacagcgagacggccaauuggucuuggcccgauggcgcggaccugccuuuuacaaucgauaaguga

SEQ ID NO: 197590 - RNA, 1410 nt, Artificial Sequence
  derived and/or modified sequence opt5 from neuraminidase__InfluenzaA__ABB86947
augaacaccaaucagagaaucauuacaaucggcacggugugccugauuguggggaucauuagccuccugucccaaaucggaaacaucguuucucuuuggauuauccacagcauucagaccggcgggaagaaucauuccgagauguguaaccagaaugugaucacauacgugaacaauaccugggucaaccggacauauauuaauaucucuaacaccaauauugccacagugaaagacguuaccagcgugauccuggcuggaaacuccucucucugccccgucagcggcugggccaucuacuccaaggauaauagcauucgcaucgggucuaaaggagacauuuucgugaucagagaaccuuuuauuuccuguagccaccuggagugccggacguucuuucuuacccagggcgcgcugcucaacgauaagcauucuaauggcacaguuaaagaccgcuccccguauagaacccugaugagcugucccaucggggaagcuccuucucccuacaacucccgguucgagagcguggccugguccgccucugcuugccacgauggaaugggcuggcugacaaucgggauuagcggaccugacaacggcgccgucgcugugcucaaguauaaugggaucauuaccgauacgaucaaguccuggcgcaacaaaauucugagaacacaagaaagcgagugugugugcaugaauggaucuuguuuuaccguccuuacagacggccccuccaacggccaggccagcuacaagaucuucaaaguugagaaggggaaaaucauuaagucuaucgaacuggaugcgccuaauuaucauuacgaggaaugcagcuguuacccggacgccggaaaggugaugugcgugugccgggauaacuggcacgcuuccaaucgccccugggucucuuuugaccagaaccucgauuaucagaugggcuacauuuguagcgggguguucggagacaauccuagauccaacgacggcaaagggaauugcggacccguucugagcaacggcgccaauggcgugaagggguuuucuuuccgguauggaaacggcgucuggaucgggcgcaccaaauccauuaauagcagaucuggauuugagaugaucugggauccuaacggcuggaccgggacagacuccagcuucuccaugaagcaagauauuaucgcucuuacggacuggucuggcuacagcggauccuuugugcagcaccccgagcugaccggcaugaacuguauccggccgugcuucuggguugaacucauucgcgggcagccuaaagagucuacaaucugggccagcggauccagcauuucuuucuguggcgucaauuccgaaaccgcgagcuggucuuggcccgauggggccgaccugccuuuuacaaucgauaaguga

SEQ ID NO: 197591 - RNA, 1410 nt, Artificial Sequence
  derived and/or modified sequence opt5 from neuraminidase__InfluenzaA__ABB86957
augaacaccaaucagagaaucauuacagugggcacggucugccugaucguugggauugugagccuccugcuucaaaucggaaacauugugucccuguggaucucucacagcauccagaccggcgagaagaaucauuccgaagucuguaaccagaauauuaucacauacgagaacaaaaccugggugaaucagacauauguuaacauuucuaauaccaacaucgccgaagggcaaggagugacaagcauuaucauggcuggcaauuccucucucugccccgucagcgggugggccauuuacuccaaggacaacagcauccggaucggaucuaaaggcgauauuuucgugauccgcgagccuuuuauuuccuguagccaccuggaaugcagaaccuucuuucuuacgcagggcgcgcugcucaaugaccggcauucuaacgggaccguuaaggaucgcuccccguauagaacacugaugagcugucccaucggagaggcuccuucucccuacaauucccgguucgagagcguggccugguccgccucugcuugccacgacggcaugggguggcugaccauuggaaucagcggcuccgauaacgaagccgucgcugugcucaaauauaacgggaucauuacagacaccaucaagagcuggcgcaauaagauucugagaacgcaggagucugaaugugugugcaucaacggauccuguuuuacaauuaugaccgauggcccuagcaauggccaggccucuuacaaaaucuucaagauggagaaagggaagaucauuaaaagcgucgagcuugaagcgcccaacuaucauuacgaggaaugcuccuguuacccugacacaggaaagguugugugcgugugccgggauaauuggcacgccucuaaccgcccgugggucagcuuuaaucaaaaccuggacuaucagaucggcuacauuuguuccgggguguucggagauaaucccagaagcaacgacggcaaggggaauugcggaccuguucccucuaacggcgcuaauggcgugaaaggguuuuccuuccgguauggaaacggcgucuggaucgggcgcaccaagagcaucuuuucuagauccggauucgagaugauuugggauccuaauggcuggaccgaaacagacagcuccuuuucuauuaaacaggacaucaucgcccucacggauuggagcggguacuccggcucuuucgugcagcaccccgagcugaccggaaugaacuguauucggccgugcuucuggguugagcuuauccgcggccaaccuaaggaaagcacaauuuggaccuccgggagcucuaucuccuuuuguggaguggacagcgagacagcuucuugguccuggcccgauggcgccgaccugccuuucaccauugauaaauga

SEQ ID NO: 197592 - RNA, 1410 nt, Artificial Sequence
  derived and/or modified sequence opt5 from neuraminidase__InfluenzaA__ABB96333
augaaccccaaucagaagaucauuaccaucggcagcgugucccugacaauugccacgaucugcuuccucaugcaaauugcuauccuggucaccacaguuacccuucacuuuaaacaguacgacugugauucuccugccaacaaucaggugaugccgugcgagcccaucauuaucgaaagaaacauuacagagaucguguaucugaccaauacaaccauugaaaaggagaucuguccuaaacucgucgaauaccggaacuggagcaagccccagugcaaaauuacgggguucgcgccuuuuuccaaggacaauucuauccgccugagcgcuggaggcgauaucugggugaccagagagcccuauguuuccugugacccugggaagugcuaccaauucgcccuuggacagggcacaacccuggauaacaaacauucuaaugacacaauucacgaucggaccccgcaucgcacgcuccugaugaacgagcugggggugcccuuucaccucggaacaagacaggucuguaucgccuggagcuccagcucuugccaugacggcaaggcuuggcugcacguguguguuaccggcuaugauaaaaaugccacagcuuccuucauuuacgacgggcggcuuguggauagcaucggaucuugguccaagaacauucugcgcacccaggaaagcgagugcgucuguaucaaugggaccugcacaguggugaugacggacggcucugccuccgaaagagcggauaccaaaauccucuuuauugaggagggaaagaucguccacauuagcccucuguccggcucugcccaacauguugaagagugcagcuguuauccccgguacccuggggugcgcugcguguguagagacaacuggaagggauccaaucggcccgucguggacaucaacguuaaagauuacagcauugcuucuuccuaugugugcagcggccuugucggcgacacaccgcgcaagaacgauagauacucuagcuccuauugucggaauccuaacaaugaaaaagggaaccacggagugaagggcugggccuucgacgaugggaaugacguuuggaugggacgcaccaucucugaugagagcagauccggcuacgaaacauuuaaagugaucgggggauggagcacccccaacucuaagcugcagauuaaucggcaggucaucguggacuccgauaacagaagcggcuauucuggcauuuucuccgucgaggggaaaagcugcaucaaucgcuguuuuuacguggagcucauucggggaagagaacaggagacgcgcguuugguggacauccaacucuaucguggucuucugcggcaccagcgggaccuauggaacaggcuccuggccugacggggcugauauuaaucugaugcccaucuga

SEQ ID NO: 197593 - RNA, 1410 nt, Artificial Sequence
  derived and/or modified sequence opt5 from neuraminidase__InfluenzaA__ABB96344
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggcggugcuaccaauucgcccuuggacagggcacaacccuggacaacaagcauucuaaugauacaauucacgaccgcaccccgcauagaacgcuccugaugaacgaacugggggugcccuuucaccucggaacacggcaggucuguaucgccuggagcuccagcucuugccaugauggcaaggcuuggcugcacguguguguuaccggcuaugacaaaaaugccacagcuuccuucauuuacgaugggcgccuuguggacagcaucggaucuugguccaaaaacauucugagaacccaggagagcgaaugcgucuguaucaaugggaccugcacaguggugaugacggaugggucugccuccgagcgggcggacaccaagguccucuuuaucgaggaaggaaaaauuguucacaucagcccucuguccggcucugcccaacauguggaggaaugcagcuguuauccccgcuacccuggggugagaugcgucugucgggauaacuggaagggauccaaucgccccgugguugacauuaacgugaaggacuacagcaucgcuucuuccuaugucugcagcggccuugugggcgauacaccgcggaaaaacgacagauacucuagcuccuauugucgcaauccuaacaaugagaaggggaaccacggaguuaaaggcugggccuucgaugacgggaaugauguguggaugggaagaaccauuucugacgaaagccgguccggcuacgagacauuuaaggucaucgggggauggagcacccccaacucuaaacugcagaucaauagacaggugauugucgauuccgacaaccgcagcggcuauucuggcaucuucuccguggagggcaagagcugcauuaaucgguguuuuuacguugaacucaucagaggacgcgagcaggaaacgcgggugugguggacauccaacucuauugucguguucugcggcaccagcgggaccuauggaacaggcuccuggccugauggggcugacaucaaucugaugcccauuuga

SEQ ID NO: 197594 - RNA, 1410 nt, Artificial Sequence
  derived and/or modified sequence opt5 from neuraminidase__InfluenzaA__ABB96398
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaacguguccuaaacucgucgaguaccggaacuggagcaagccccagugcaaaaucaccggguucgcgccuuuuuccaaggauaauucuauucgccugagcgcuggaggcgacaucugggugacaagagagcccuauguuuccugugauccugggaagugcuaccaauucgcccuuggacagggcaccacacuggacaacaaacauucuaaugauaccauccacgaccggacgccguaucgcacacuccugaugaacgaacugggggugcccuuucaucucggaaccagacaggucuguauugccuggagcuccagcucuugccacgauggcaaggcuuggcugcauguguguguuacaggcuacgacaaaaaugccaccgcuuccuucaucuaugaugggcggcuuguggacagcauuggaucuugguccaagaacauccugcgcacccaggagagcgaaugcgucuguauuaauggcacaugcacgguggugaugaccgaugggucugccuccgagagagcggacacaaaaauccucuuuaucgaggaaggaaagauuguccacaucagcccucuguccggcucugcccaacacguugaggaaugcagcuguuacccccgguacccuggggugcgcugcguguguagagauaacuggaagggauccaaucggcccgucguggacauuaacguuaaagacuauagcaucgcuucuuccuacgugugcagcggccuugucggcgauaccccgcgcaagaacgacagaucuagcuccucuuauugucggaauccuaacaaugagaaagggaaccauggagugaagggcugggccuucgaugacgggaaugauguuuggaugggacgcacaauuagcgaagaguccagaagcggcuacgagaccuuuaaagugaucgggggauggucuacgcccaacuccaagcugcagaucaaucggcaggucauuguggacagcgauaacagaucuggcuauuccggcaucuucagcgucgaagggaaauccugcauuaaucgcuguuuuuacguggagcucauccggggaagagaacaggagacacgcguuugguggaccucuaacagcauuguggucuucugcggcaccuccgggacauauggaaccggcucuuggccugacggggcugauaucaaucugaugcccauuuga

SEQ ID NO: 197595 - RNA, 1410 nt, Artificial Sequence; identical to SEQ ID NO: 197406
  derived and/or modified sequence opt5 from neuraminidase__InfluenzaA__ABB96490

SEQ ID NO: 197596 - RNA, 1410 nt, Artificial Sequence
  derived and/or modified sequence opt5 from neuraminidase__InfluenzaA__ABB96501
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccgagcaagugcuaccaauucgcucuugggcagggaacaacccuggauaacaaacauuccaaugacacaauucacgaucggacgccccaucgcacccuccugaugaacgaacugggcgugccuuuucaccucgggacaagacaggucuguaucgccuggucuagcuccagcugccaugacggaaaggccuggcugcacguguguguuaccggcuaugauaaaaaugcuacagccucuuucauuuacgacggccggcuuguggauuccaucgggagcuggucuaagaacauucugcgcacccaggaguccgaaugcgucuguaucaauggaaccugcacaguggugaugacggacggcagcgcuuccgagagagccgauaccaaaauccucuuuauugaggaagggaagaucguccacauuucuccccugagcggauccgcgcaacauguugaggaaugcagcuguuauccucgguaccccggcgugcgcugcguguguagagacaacuggaaggggucuaaucggccggucguggauaucaacguuaaagacuacuccauugugagcucuuaugucugcagcggacuugugggcgacacaccucgcaagaacgauagauccucuagcuccuacugucggaaucccaacaaugagaaaggcaaccacgggguuaagggaugggccuucgacgauggcaaugacguguggauggggcgcaccaucagcgaagagucuagauccggauaugagacauuuaaagucaucggcggguggagcaccccuaacucuaagucccagauuaauagacaggugaucgucgauagcggaaaccgguccggcuacucuggcauuuucagcguggaagggaaauccugcaucaaucgcuguuuuuauguugagcugauucggggaagagaacaggagacgcgcgugugguggacaucuaacagcaucgucguguucugcggcaccuccgggaccuacggaacaggcagcuggcccgacggggcugauauuaaucucaugcccaucuga

SEQ ID NO: 197597 - RNA, 1410 nt, Artificial Sequence
  derived and/or modified sequence opt5 from neuraminidase__InfluenzaA__ABB96534
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuuccccucuuucuggcagcgcccaacauguugaggaaugcuccuguuauccccgguacccuggggugcgcugcguguguagagacaacuggaagggaagcaaucggcccaucgucgauauuaacgugaaagacuacucuaucguuuccagcuaugugugcucuggccuggucggcgacaccccgcgcaagaacgauagcuccucuagcucccacugucucaauccuaacaaugaggaagggggacauggcgugaaagggugggcuuucgacgauggaaacgacguuuggaugggcagaacaauuagcgagaaguuucggucuggguacgagaccuucaaagugaucgaaggaugguccaagcccaauagcaaacugcagaucaaccgccaggucauuguggauagaggcaaucggucuggcuauuccgggaucuuuagcgucgagggaaaguccugcauuaacagauguuucuacguggaacugauccgcggccggaagcaggagacggaaguuugguggacaucuaauagcauuguggucuuuugcgggaccuccggaaccuauggcacagggucuuggccugacggcgccgauaucaaccucaugcccauuuga

SEQ ID NO: 197598 - RNA, 1410 nt, Artificial Sequence
  derived and/or modified sequence opt5 from neuraminidase__InfluenzaA__ABC02237
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuucccaacuuucuggcagcgcccagcauguugaggaaugcuccuguuauccucgguaccccggggugcgcugcguguguagagacaacuggaagggaagcaaucggccuaucgucgauauuaacaucaaagacuacucuauuguguccagcuauguuugcucuggccuggugggcgacacaccccgcaagaacgauagcuccucuagcucccacugucucaauccgaacaaugaggaagggggacauggcgucaaagggugggcuuucgacgauggaaacgacguguggaugggcagaaccaucagcgagaaguuucggucuggguacgagaccuucaaaguuaucgaaggaugguccaagccuaauagcaaacugcagauuaaccgccaggugaucgucgauagaggcaaucggucuggcuauuccgggauuuuuagcguggagggaaaguccugcaucaacagauguuucuacgucgaacugauucgcggccggaagcaagagacggaagugugguggacaucuaauagcaucguugccuuuugcgggaccuccggaaccuauggcacagggucuuggcccgacggcgcugauauuaaccucaugccuaucuga

SEQ ID NO: 197599 - RNA, 1410 nt, Artificial Sequence
  derived and/or modified sequence opt5 from neuraminidase__InfluenzaA__ABC02258
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucagaucaugccgugcgaacccacaauuaucgagagaaacauuaccgaaaucguguaucugacaaauauuaccaucgagaaggaaauuuguccuaaacucguggaguaccggaacuggagcaagccccagugcaaaaucacgggguucgcgccuuuuuccaaggauaauucuauccgccugagcgcuggaggcgacauuugggucaccagagagcccuauguguccugugauccuucuaagugcuaccaauucgcccuugggcagggaacaacccuggacaacaaacauagcaaugauacaauccacgaccggaccccgcaucgcacgcuccugaugaacgaacugggcguucccuuucaccucgggacaagacagguguguauugccugguccucuagcuccugccaugauggaaaggcuuggcugcacgucugugugaccggcuaugacaaaaaugccacagcuagcuucaucuacgauggccggcuuguugacucuauuggguccuggagccagaacauccugcgcacccaagagucugaaugcguguguaucaauggaaccugcacagucgugaugacggauggcuccgccagcgggagagcggacaccaagauucucuuuaucgaggagggaaaaauugugcacaucuccccucugucuggcagcgcccagcaugucgaagagugcuccuguuauccccgguacccugggguucgcugcauuuguagagauaacuggaagggaagcaaucggcccgugguggacaucaacgucaaggacuacucuaucgauuccagcuaugugugcucuggccuuguuggcgacacaccgcgcaaaaacgauagaagcuccaauucuuacugucggaacccuaauaacgaaaaggggaaucacggagugaaaggcugggcuuucgacgaugggaacgacgucuggaugggacgcaccauuagcgaggauuccagaagcggcuaugaaacauuuaaggugaucgggggauggucuacccccaauuccaaacugcagauuaaccggcagguuaucguggacagcgauaauagaucuggcuacuccggcauuuucagcgucgaggggaaguccugcaucaaccgcuguuuuuauguggagcucauucggggaagagaacaagagacgcgcgucugguggacaucuaauagcaucgugguuuucugcggcaccuccgggaccuacggagccggcucuuggccugacggggcugauaucaaccugaugcccauuuga

SEQ ID NO: 197600 - RNA, 1410 nt, Artificial Sequence
  derived and/or modified sequence opt5 from neuraminidase__InfluenzaA__ABC02269
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggaagggcuccaaucggcccguggucgacaucaacgugaaggacuacagcauugauucuuccuauguuugcagcggccuugugggggacaccccgcgcaacaaugauagaucuagcuccucuuacugucggaacccuaauaacgaaaaaggaacacacggcgucaaggggugggcuuucgacgauggaaaugacguguggaugggccgcaccaucagcgaggauuccagaagcggguaugaaacguuuaaaguuaucggaggcuggucuacacccaacuccaagcugcagauuaauagacaggugaucgucgacagcgauaaccggucuggcuacuccgggauuuucagcguggagggaaaauccugcaucaaucgcuguuuuuaugucgagcucauucggggcagagaacaagagacccgcgugugguggaccucuaacagcaucguuguguucugcgggacauccggaaccuacggcacagggucuuggccugacggcgccgauauuaaucugaugcccaucuga

SEQ ID NO: 197601 - RNA, 1413 nt, Artificial Sequence
  derived and/or modified sequence opt5 from neuraminidase__InfluenzaA__ABC02280
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcagccugcuuaaugauaaacacucuaacgggacaguuaaggaccgguccccguaucgcgcccugaugagcugcccccucggagaagccccuucccccuacaauucuaaguucgagagcguggcuugguccgccagcgcuugucaugauggcaugggguggcugaccaucggaauuucuggcccugacaacggggccgucgcggugcugaaauauaacggaaucauuacagaaaccaucaaguccuggaaaaagcagauucucagaacgcaggagagcgagugcguuugugugaauggcucuugcuuuacaaucaugaccgauggccccagcaacggggccgcuuccuacaaaaucuucaagauugaaaagggaaaagucacaaagucuaucgagcugaaugccccuaacuuucacuaugaagaguguagcugcuacccggacaccggcaccgugaugugugugugccgggauaauuggcacggguccaaccgccccugggucagcuucaaucagaaccuugacuaccaaauuggauauaucugcucuggcguuuuuggggauaauccuagacccaaagacggagagggcuccuguaacccugugacaguggauggcgcuaauggggucaagggauucagcuacaaauauggcaacgggguguggauuggacggacgaagucuaaucgccugagaaaaggcuuugaaaugaucugggaccccaacggguggaccgacacagauuccgacuucagcguuaagcaggauguggucgccauuaccgacugguccggcuacucuggauccuuugugcagcauccggagcucacaggccuggauugcauccggccuuguuucuggguugaacuugugcgcgggcugcccaaggagaauaccacgaucuggacauccggaucuagcauuuccuucugcggcgucaacagcgacaccgcgaacuggucuuggccugauggggccgaacuccccuuuaccaucgacaaauga

SEQ ID NO: 197602 - RNA, 1410 nt, Artificial Sequence; identical to SEQ ID NO: 197597
  derived and/or modified sequence opt5 from neuraminidase__InfluenzaA__ABC02302

SEQ ID NO: 197603 - RNA, 1410 nt, Artificial Sequence; identical to SEQ ID NO: 197594
  derived and/or modified sequence opt5 from neuraminidase__InfluenzaA__ABC02313

SEQ ID NO: 197604 - RNA, 1410 nt, Artificial Sequence; identical to SEQ ID NO: 197599
  derived and/or modified sequence opt5 from neuraminidase__InfluenzaA__ABC02324

SEQ ID NO: 197605 - RNA, 1410 nt, Artificial Sequence
  derived and/or modified sequence opt5 from neuraminidase__InfluenzaA__ABC02335
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauuaaagagggcaagaucguccacauuagcccucuguccgggucugcccagcauguugaggaaugcagcuguuauccccgguacccuggagugcgcugcaucuguagagauaacuggaagggcuccaaucggcccguggucgacauuaacgugaaagacuacagcaucgauucuuccuauguuugcagcggccuugugggggacacaccgcgcaacaaugauagaucuagcaacuccuacugucggaauccuaacaaugagaagggaaaccacggcgucaaagggugggcuuucgacgauggaaaugacguguggaugggccgcaccaucucugaagauagcagauccggguaugagacauuuaagguuauuggaggcuggagcacccccaacucuaaacugcagaucaauagacaggugauugucgacuccgauaaccggagcggcuacucugggaucuucuccguggaaggaaagagcugcauuaaucgcuguuuuuaugucgagcucauccggggcagagagcaagaaacgcgcgugugguggacauccaacucuauuguuguguucugcgggaccagcggaaccuacggcacaggguccuggccugacggcgccgauaucaaucugaugcccaucuga

SEQ ID NO: 197606 - RNA, 1410 nt, Artificial Sequence
  derived and/or modified sequence opt5 from neuraminidase__InfluenzaA__ABC39808
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccgagcaagugcuaccaauucgcucuugggcagggaacaacccuggauaacaaacauuccaaugacacaauucacgaucggacgccccaucgcacccuccugaugaacgaacugggcgugccuuuucaccucgggacaagacaggucuguaucgccuggucuagcuccagcugccaugacggaaaggccuggcugcacguguguguuaccggcuaugauaaaaaugcuacagccucuuucauuuacgacggccggcuuguggauuccaucgggagcuggucuaagaacauucugcgcacccaggaguccgaaugcgucuguaucaauggaaccugcacaguggugaugacggacggcagcgcuuccgagagagccgauaccaaaauccucuuuauugaggaagggaagaucguccacauuucuccccugagcggauccgcgcaacauguugaggaaugcagcuguuauccucgguaccccggcgugcgcugcguguguagagacaacuggaaggggucuaaucggccggucguggauaucaacguuaaagacuacuccauugugagcucuuaugucugcagcggacuugugggcgacacaccucgcaagaacgauagauccucuagcuccuacugucggaaucccaacaaugagaaaggcgaccacgggguuaagggaugggccuucgaugacggcaacgauguguggauggggcgcaccaucagcgaagagucuagauccggauaugagacauuuaaagucaucggcggguggagcaccccuaauucuaagucccagauuaacagacaggugaucgucgacagcggaaaucgguccggcuacucuggcauuuucagcguggaagggaaauccugcaucaaccgcuguuuuuauguugagcugauucggggaagaaagcaggaaacgcgcgugugguggacaucuaauagcaucgucguguucugcggcaccuccgggaccuacggaacaggcagcuggcccgauggggcugacauuaaccucaugcccaucuga

SEQ ID NO: 197607 - RNA, 1410 nt, Artificial Sequence; identical to SEQ ID NO: 197406
  derived and/or modified sequence opt5 from neuraminidase__InfluenzaA__ABC40525

SEQ ID NO: 197608 - RNA, 1413 nt, Artificial Sequence
  derived and/or modified sequence opt5 from neuraminidase__InfluenzaA__ABC40536
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucaucaaguccauugagcugaaugcuccuaacuuucacuaugaagaguguucuugcuacccggacacaggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugaccguggauggcgccaauggggucaagggauucuccuacaaauauggcaacgggguguggaucggacggacaaagagcaaucgccugagaaaaggcuuugaaaugauuugggaccccaacggguggacggacaccgauucugacuucuccguuaagcaggauguggucgcgaucacagacuggagcggcuacuccggaucuuuugugcagcauccggagcucaccggccuggauugcauccggccuuguuucuggguugaacuugugcgcgggcugcccaaggagaauacaaccauuuggacgagcggauccucuaucagcuucugcggcgucaacuccgacacagccaacuggagcuggccugauggggcugaacuccccuuuaccauugacaaauga

SEQ ID NO: 197609 - RNA, 1410 nt, Artificial Sequence; identical to SEQ ID NO: 197600
  derived and/or modified sequence opt5 from neuraminidase__InfluenzaA__ABC40547

SEQ ID NO: 197610 - RNA, 1410 nt, Artificial Sequence
  derived and/or modified sequence opt5 from neuraminidase__InfluenzaA__ABC40558
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccucuagcuccugccacgacggcaaggccuggcugcauguguguguuaccggccacgauaaaaaugcuacagccagcuucauuuacgacgggcggcuuguggauucuaucggauccuggagcaagucuauucugcgcacccaggaguccgaaugcgucuguaucaacgggaccugcacaguggugaugacggacggcagcgcuuccgagagagccgauaccaaaauccucuuuauugaggaaggaaagaucguccacauuucuccccugagcggcuccgcgcaacauguugaggaaugcagcuguuauccucgguaccccggggugcgcugcguguguagagacaauuggaagggaucuaaccggccggucguggauaucaauguuaaagacuacuccauugugagcucuuaugucugcagcggccuugugggcgacacaccucgcaagaacgauagauccucuagcuccuacugucagaaccccaauaacgagaaagggaaucacggaguuaagggcugggccuucgacgaugggaacgacguguggaugggacggaccaucagcgaagagucucgcuccggcuaugagacauuuaaagucaucgggggauggagcaccccuaauucuaagcugcagauuaacagacaggugaucgucgauauugacaaucgguccggcuacagcggcaucuucuccguggaagggaaaucuugcauuaacagauguuuuuauguugagcucauccgcggacgggaacaagagacgagagugugguggacaagcaauuccauugucguguucugcggcaccucugggaccuacggaacaggcagcuggcccgauggggcugacaucaaccugaugcccaucuga

SEQ ID NO: 197611 - RNA, 1410 nt, Artificial Sequence
  derived and/or modified sequence opt5 from neuraminidase__InfluenzaA__ABC40611
augaaccccaaucagaagaucauuaccaucggcagcauuucccugacaaucgccacgauuugcuuccucaugcaaaucgcuauccugguuaccacagucacccuucacuuuaaacaguacgaguguaacucucugccuaauaaccagguuaugcucugcgaaccgacaauuaucgagagaaauauuaccgaaaucguguaucugacaaacaccacgauugagaaggaaaucugucccaaacuugccgaguaccggaauuggagcaagccucagugcaaaauuaccggguucgcgcccuuuuccaaggacaacucuauccgccugagcgcuggaggcgauaucugggugacaagagagccuuaugucuccugugaccccgauaagugcuaccaauucgcccucgggcagggaaccacacugaauaaccggcauucuaaugacaccgugcacgaucgcacgccuuauagaacacugcucaugaacgaacugggcguuccguuucaucuugggaccaaacagguguguauugccuggagcuccagcucuugccacgacggaaaggcuuggcugcaugucugugugacaggccacgaugagaaugccaccgcuuccuucaucuacgacggccggcucguugauagcauugggucuugguccaaaaagauccugcgcacccaggaaagcgagugcguguguauuaacggaacaugcacggucgugaugaccgacggcucugccuccgggagagcggauacaaaaauccuuuuuaucgaggaaggaaagauuauccacauuagccaacuguccggcucugcccagcauguggaggaaugcagcuguuauccccgguacccugggguccgcugcguuuguagagacaauuggaagggauccaaccggcccaucguggauauuaacgugaaagacuacagcaucgucucuuccuaugugugcagcggccucguuggcgacaccccucgcaagaaugauucuagcuccucuagccacugucugaaccccaauaacgaggaagggggacauggcgugaaagggugggcuuucgacgauggaaaugacgucuggaugggcagaacaaucuccgagaaguuucggagcggguacgagaccuucaaagugauugaaggauggucuaagccgaacuccaaacugcagaucaaucgccagguuauuguggauagagacaaccggagcggcuauucuggcaucuuuuccgucgagggaaagagcugcauuaauagauguuucuacguggaacucauccgcgggcggaagcaagagacggaagucugguggacauccaacucuauugugguguuuugcggcaccagcgggaccuauggaacaggcuccuggccugauggggccgacaucaaucugaugcccaucuga

SEQ ID NO: 197612 - RNA, 1410 nt, Artificial Sequence
  derived and/or modified sequence opt5 from neuraminidase__InfluenzaA__ABC40622
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggaacgccucuggcagagcggacaccaagauccucuuuauugaggagggcaaaaucguccacauuuccccucugagcggguccgcccagcauguugaagagugcucuuguuauccccgguacccuggagugcgcugcaucuguagagauaauuggaagggcagcaaccggcccguggucgacauuaacgugaaggacuacuccaucgauagcucuuauguuugcuccggccuugugggggacacaccgcgcaauaacgauagaagcucuaauagcuacugucggaacccuaauaacgaaaaaggaaaucacggcgucaaggggugggcuuucgacgauggaaacgacguguggaugggccgcaccaucuccgaggauucuagaagcggguaugaaacauuuaaaguuauuggaggcugguccacccccaauagcaagcugcagaucaacagacaggugauugucgacucugauaaucgguccggcuacagcgggaucuucucuguggagggaaaauccugcauuaaccgcuguuuuuaugucgagcucauccggggcagagaacaagagacgcgcgugugguggacaagcaauuccauuguuguguucugcgggaccucuggaaccuacggcacagggagcuggccugacggcgccgauaucaaccugaugcccaucuga

SEQ ID NO: 197613 - RNA, 1410 nt, Artificial Sequence
  derived and/or modified sequence opt5 from neuraminidase__InfluenzaA__ABC40634
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucgacggcacgugcaccguggugaugacagaugggucugccuccggaaaagcggacaccaagauucuguuuaucgaggagggcaagaucguccacacaagccuucuguccgggucugcccaacacguugaagagugcagcuguuauccucgcuaccccggagugagaugcgugugucgggauaacuggaaaggcuccaaccgcccuauugucgacaucaaugugaaggacuacagcauuguuucuuccuaugugugcagcggccucgucggggauacccccagaaagaacgacucuagcuccucuagccauugucuggauccgaauaacgaagagggaggccacggggugaaaggaugggcuuucgacgauggcaaugacguuuggauggggcggacgaucuccgaaaaacugcgcagcggauacgagacauuuaaggugauugagggcuggucuaaaccuaacuccaagcuccagaucaauagacaggucaucguggaucggggcaaccgcagcggguauucuggaauuuucuccgucgaaggcaagagcugcaucaauagauguuuuuacguggagcugauucgggggagaaaccaggaaaccgagguucuuuggaccuccaauucuaucguggucuucugcggaacaagcggcaccuaugggacaggcuccuggcccgacggagccgauauuaaccugaugccuaucuga

SEQ ID NO: 197614 - RNA, 1410 nt, Artificial Sequence
  derived and/or modified sequence opt5 from neuraminidase__InfluenzaA__ABC40645
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucugucguguccuggagcaagaaaauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgauguguggaugggacggacgauuagcgagaagcuccgcucuggcuacgagacauuuaaagucaucgaagggugguccaauccuaacagcaagcugcagaucaauagacaggugauugucgaccggggaaaccgcucuggcuauuccggcaucuucagcguggaggggaaauccuguauuaauagaugcuuuuacguugaacugauccggggaagaaagcaggagaccgaagugcucuggaccucuaacagcauugucguguucuguggcacauccgggaccuauggaacaggcucuuggcccgauggggcugacaucaaucugaugccuauuuga

SEQ ID NO: 197615 - RNA, 1410 nt, Artificial Sequence
  derived and/or modified sequence opt5 from neuraminidase__InfluenzaA__ABC41706
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaaguccugcauuaaccgguguuucuauguugaacucaucagagggcgcaaggaggaaacagaggugugguggaccagcaauuccauugucguguuuugcggaaccucuggcacauacgggaccggcagcuggcccgacggagcugauaucaaccugaugccuauuuga

SEQ ID NO: 197616 - RNA, 1413 nt, Artificial Sequence
  derived and/or modified sequence opt5 from neuraminidase__InfluenzaA__ABC41717
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcggugaccgauuggagcggcuacuccggaucuuuuguucagcauccggaacucacaggccuggacugcauucgcccuuguuucuggguggagcuugucagagggcugccccgggaaaacaccacgaucuggacaagcggauccucuaucagcuucugcggcguggauuccgacaccgccaauuggagcuggccugauggggcugagcuccccuuuaccauugacaaauga

SEQ ID NO: 197617 - RNA, 1410 nt, Artificial Sequence
  derived and/or modified sequence opt5 from neuraminidase__InfluenzaA__ABC41728
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaacauucuccgcacccaggagagcgaaugcguguguaucaacggcacaugcacgguggucaugaccgacgggucugcuuccggaaaagccgauacaaagauucuguuuaucgaggagggcaaaaucguucacauuagcacccuuuccgggucugcgcaacauguggaagagugcagcuguuacccuagauaucccggagugcggugcgucugucgcgacaauuggaagggcuccaacagaccuaucguggauauuaauguuaaggacuacagcaucgugucuuccuacgucugcagcggccuggugggggacacaccccggaaaaacgauucuuucagcuccucucacugucucgacccgaauaacgaagagggaggccaugggguuaagggaugggccuuugaugacggcaaugauguguggauggggcgcaccauuagcgaaaaacugagauccggauaugagacguucaaggucaucgagggcuggagcaaaccuaacucuaagcugcagaucaaucgccaggugauugucgaacggggcaacagauccggguacagcggaaucuuuucuguggagggcaaauccugcauuaaucgguguuucuauguugaacucaucagagggcgcaaggaggaaacagaggugugguggaccagcaacuccauugucguguuuugcggaaccucuggcacauacgggaccggcagcuggcccgacggagcugauaucaaucugaugccuauuuga

SEQ ID NO: 197618 - RNA, 1410 nt, Artificial Sequence; identical to SEQ ID NO: 197615
  derived and/or modified sequence opt5 from neuraminidase__InfluenzaA__ABC41742

SEQ ID NO: 197619 - RNA, 1410 nt, Artificial Sequence; identical to SEQ ID NO: 197615
  derived and/or modified sequence opt5 from neuraminidase__InfluenzaA__ABC41956

SEQ ID NO: 197620 - RNA, 1410 nt, Artificial Sequence; identical to SEQ ID NO: 197615
  derived and/or modified sequence opt5 from neuraminidase__InfluenzaA__ABC41967

SEQ ID NO: 197621 - RNA, 1410 nt, Artificial Sequence; identical to SEQ ID NO: 197615
  derived and/or modified sequence opt5 from neuraminidase__InfluenzaA__ABC42017

SEQ ID NO: 197622 - RNA, 1410 nt, Artificial Sequence; identical to SEQ ID NO: 197615
  derived and/or modified sequence opt5 from neuraminidase__InfluenzaA__ABC42117

SEQ ID NO: 197623 - RNA, 1410 nt, Artificial Sequence; identical to SEQ ID NO: 197615
  derived and/or modified sequence opt5 from neuraminidase__InfluenzaA__ABC42128

SEQ ID NO: 197624 - RNA, 1410 nt, Artificial Sequence; identical to SEQ ID NO: 197615
  derived and/or modified sequence opt5 from neuraminidase__InfluenzaA__ABC42139

SEQ ID NO: 197625 - RNA, 1410 nt, Artificial Sequence
  derived and/or modified sequence opt5 from neuraminidase__InfluenzaA__ABC42150
augaaccccaaucagaagaucauuaccaucggcagcgugucccugacaauugccacgaucugcuuccucaugcaaauugcuauccuggccaccacagucacccuucacuuuaaacagcaugaguguaacucuccuccgaauaaccagguuaugcugugcgaacccacaaucauugagagaaauaucaccgaaauuguguaccucacaaacaccacgaucgagaaggaaauuuguccuaaacugguggaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcggaaagcugagauccggcuaugaaacguucaaagugaucgagggcuggagcaagccuaauucuaaacugcagaucaaccggcaggucauuguggagcgcgggaauagauccggauacagcggcaucuuuucugucgaagggaaguccugcauuaaccgguguuucuauguggagcucaucagaggacgcaaggaagagacagaaguuugguggaccagcaauuccauuguggucuuuugcggcaccucugggacauacggcaccggaagcuggcccgacggcgccgauaucaaccugaugccuauuuga

SEQ ID NO: 197626 - RNA, 1410 nt, Artificial Sequence; identical to SEQ ID NO: 197615
  derived and/or modified sequence opt5 from neuraminidase__InfluenzaA__ABC42161

SEQ ID NO: 197627 - RNA, 1410 nt, Artificial Sequence
  derived and/or modified sequence opt5 from neuraminidase__InfluenzaA__ABC42172
augaaccccaaucagaagaucauuaccaucggcagcgugucccugacaauugccacgaucugcucucucaugcaaauugcuauccuggucaccacaguuacccuucacuucaaacagcaugaguguaacagcccuccgaauaaccaggugaugcugugcgaacccacaaucauugagagaaauaucaccgaaauuguguaccucacaaacaccacgaucgagaaggaaauuuguccuaaacuggucgaguaucggaauugguccaagccccagugcaacaucaccggguuugccccuuucucuaaagacaauagcauucgccuuuccgcgggaggcgauaucugggugacaagagagcccuacguuucuugugacccugauaagugcuaucaauuugcucuggggcagggaaccacacucaacaauggccacagcaacgacaccgugcaugaucggacgccguaccgcacacugcugaugaaugaacucgggguccccuuccaccugggaaccagacagguguguaucgccugguccucuagcuccugccaugacggcaaggccuggcuucacguuugugugacaggcgaugacaaaaacgcuaccgccagcuuuauuuauaaugggcggcuggucgauucuaucggauccuggagcaagaaaauucuccgcacccaggagucugaaugcguguguaucaacggcacaugcacgguggucaugaccgacggguccgcuagcggaaaggccgauacaaaaauucuguucaucgaggagggcaagaucguucacauuuccacccuuucugggagcgcgcaacauguggaagagugcuccuguuacccuagauaucccggagugcggugcgucugucgcgacaacuggaagggcagcaauagaccuaucguggauauuaacguuaaagacuacucuaucguguccagcuacgucugcucuggccuggugggggacacaccccggaagaaugauagcuuuuccucuagccacugucucgacccgaacaaugaagagggaggccaugggguuaaaggaugggccuucgaugacggcaacgauguguggauggggcgcaccauuuccgaaaagcugagaagcggauaugagacguuuaaagucaucgagggcuggucuaagccuaauuccaaacugcagaucaaccgccaggugauugucgaacggggcaauagaagcggguacucuggaaucuucuccguggagggcaagagcugcauuaaccgguguuuuuauguugaacucaucagagggcgcaaggaggaaacagaggugugguggaccuccaauucuauugucguguucugcggaaccagcggcacauacgggaccggcuccuggcccgacggagcugauaucaaccugaugccuauuuga

SEQ ID NO: 197628 - RNA, 1410 nt, Artificial Sequence; identical to SEQ ID NO: 197615
  derived and/or modified sequence opt5 from neuraminidase__InfluenzaA__ABC42183

SEQ ID NO: 197629 - RNA, 1410 nt, Artificial Sequence; identical to SEQ ID NO: 197615
  derived and/or modified sequence opt5 from neuraminidase__InfluenzaA__ABC42195

SEQ ID NO: 197630 - RNA, 1410 nt, Artificial Sequence; identical to SEQ ID NO: 197615
  derived and/or modified sequence opt5 from neuraminidase__InfluenzaA__ABC42310

SEQ ID NO: 197631 - RNA, 1410 nt, Artificial Sequence; identical to SEQ ID NO: 197615
  derived and/or modified sequence opt5 from neuraminidase__InfluenzaA__ABC42321

SEQ ID NO: 197632 - RNA, 1410 nt, Artificial Sequence; identical to SEQ ID NO: 197615
  derived and/or modified sequence opt5 from neuraminidase__InfluenzaA__ABC42349

SEQ ID NO: 197633 - RNA, 1410 nt, Artificial Sequence; identical to SEQ ID NO: 197615
  derived and/or modified sequence opt5 from neuraminidase__InfluenzaA__ABC42464

SEQ ID NO: 197634 - RNA, 1410 nt, Artificial Sequence; identical to SEQ ID NO: 197615
  derived and/or modified sequence opt5 from neuraminidase__InfluenzaA__ABC42497

SEQ ID NO: 197635 - RNA, 1410 nt, Artificial Sequence; identical to SEQ ID NO: 197615
  derived and/or modified sequence opt5 from neuraminidase__InfluenzaA__ABC42508

SEQ ID NO: 197636 - RNA, 1410 nt, Artificial Sequence; identical to SEQ ID NO: 197615
  derived and/or modified sequence opt5 from neuraminidase__InfluenzaA__ABC42519

SEQ ID NO: 197637 - RNA, 1410 nt, Artificial Sequence; identical to SEQ ID NO: 197615
  derived and/or modified sequence opt5 from neuraminidase__InfluenzaA__ABC42530

SEQ ID NO: 197638 - RNA, 1410 nt, Artificial Sequence; identical to SEQ ID NO: 197615
  derived and/or modified sequence opt5 from neuraminidase__InfluenzaA__ABC42577

SEQ ID NO: 197639 - RNA, 1410 nt, Artificial Sequence; identical to SEQ ID NO: 197615
  derived and/or modified sequence opt5 from neuraminidase__InfluenzaA__ABC42588

SEQ ID NO: 197640 - RNA, 1410 nt, Artificial Sequence; identical to SEQ ID NO: 197351
  derived and/or modified sequence opt5 from neuraminidase__InfluenzaA__ABC42599

SEQ ID NO: 197641 - RNA, 1410 nt, Artificial Sequence; identical to SEQ ID NO: 197351
  derived and/or modified sequence opt5 from neuraminidase__InfluenzaA__ABC42610

SEQ ID NO: 197642 - RNA, 1410 nt, Artificial Sequence; identical to SEQ ID NO: 197351
  derived and/or modified sequence opt5 from neuraminidase__InfluenzaA__ABC42621

SEQ ID NO: 197643 - RNA, 1410 nt, Artificial Sequence; identical to SEQ ID NO: 197351
  derived and/or modified sequence opt5 from neuraminidase__InfluenzaA__ABC42632

SEQ ID NO: 197644 - RNA, 1410 nt, Artificial Sequence; identical to SEQ ID NO: 197351
  derived and/or modified sequence opt5 from neuraminidase__InfluenzaA__ABC42643

SEQ ID NO: 197645 - RNA, 1410 nt, Artificial Sequence; identical to SEQ ID NO: 197351
  derived and/or modified sequence opt5 from neuraminidase__InfluenzaA__ABC42654

SEQ ID NO: 197646 - RNA, 1410 nt, Artificial Sequence; identical to SEQ ID NO: 197351
  derived and/or modified sequence opt5 from neuraminidase__InfluenzaA__ABC42665

SEQ ID NO: 197647 - RNA, 1410 nt, Artificial Sequence; identical to SEQ ID NO: 197351
  derived and/or modified sequence opt5 from neuraminidase__InfluenzaA__ABC42676

SEQ ID NO: 197648 - RNA, 1410 nt, Artificial Sequence; identical to SEQ ID NO: 197351
  derived and/or modified sequence opt5 from neuraminidase__InfluenzaA__ABC42687

SEQ ID NO: 197649 - RNA, 1410 nt, Artificial Sequence; identical to SEQ ID NO: 197351
  derived and/or modified sequence opt5 from neuraminidase__InfluenzaA__ABC42698

SEQ ID NO: 197650 - RNA, 1410 nt, Artificial Sequence; identical to SEQ ID NO: 197351
  derived and/or modified sequence opt5 from neuraminidase__InfluenzaA__ABC42709

SEQ ID NO: 197651 - RNA, 1410 nt, Artificial Sequence; identical to SEQ ID NO: 197351
  derived and/or modified sequence opt5 from neuraminidase__InfluenzaA__ABC42720

SEQ ID NO: 197652 - RNA, 1410 nt, Artificial Sequence
  derived and/or modified sequence opt5 from neuraminidase__InfluenzaA__ABC42742
augaaccccaaucagaagaucauuaccaucggcagcgugucccugacaauuucuacgaucugcuucuuuaugcaaauugccauccucaugaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcaucgccugguccucuagcuccugucacgauggaaaagccuggcugcaugugugcguuacaggcgacgauaagaaugcuaccgccagcuucauuuacaacggcagacuuguggacucuaucgucuccuggagcaaagagauucugcggacccaggaaucugagugugugugcaucaaugggacauguacgguggucaugaccgauggauccgcuagcggcaaggccgacacaaaaauucucuuuaucgaggaagggaagaucguucacaccuccacacugucuggaagcgcgcaacacguggaggaaugcuccugcuauccucgcuaccccggcgugagaugugucugccgggauaacuggaaggggagcaaccgcccuauuguggacaucaauauuaaagacuacucuaucguuuccagcuauguguguucuggacuugucggcgauacccccagacggaacgacagcuccucuagcucccauugccuggauccgaauaacgaggaaggcgggcacggagugaagggcugggccuucgacgaugggaaugacguuuggaugggacgcacgauuagcgagaaacucagaucuggcuacgagacauuuaaggugaucgaagggugguccaacccuaauagcaaacugcagaucaaccggcaggucauuguggaucgcggaaauagaucuggcuauuccggcaucuucagcgucgaggggaaguccuguauuaaccggugcuuuuacguggaacugaucagaggacgcaaagaggaaaccgagguucucuggaccucuaauagcauuguggucuucuguggcacauccgggaccuauggaacaggcucuuggcccgacggggcugauaucaaccugaugccuauuuga

SEQ ID NO: 197653 - RNA, 1410 nt, Artificial Sequence; identical to SEQ ID NO: 197351
  derived and/or modified sequence opt5 from neuraminidase__InfluenzaA__ABC42764

SEQ ID NO: 197654 - RNA, 1410 nt, Artificial Sequence; identical to SEQ ID NO: 197351
  derived and/or modified sequence opt5 from neuraminidase__InfluenzaA__ABC42775

SEQ ID NO: 197655 - RNA, 1410 nt, Artificial Sequence; identical to SEQ ID NO: 197351
  derived and/or modified sequence opt5 from neuraminidase__InfluenzaA__ABC42786

SEQ ID NO: 197656 - RNA, 1410 nt, Artificial Sequence; identical to SEQ ID NO: 197351
  derived and/or modified sequence opt5 from neuraminidase__InfluenzaA__ABC42797

SEQ ID NO: 197657 - RNA, 1410 nt, Artificial Sequence; identical to SEQ ID NO: 197351
  derived and/or modified sequence opt5 from neuraminidase__InfluenzaA__ABC42808

SEQ ID NO: 197658 - RNA, 1410 nt, Artificial Sequence; identical to SEQ ID NO: 197351
  derived and/or modified sequence opt5 from neuraminidase__InfluenzaA__ABC42819

SEQ ID NO: 197659 - RNA, 1410 nt, Artificial Sequence
  derived and/or modified sequence opt5 from neuraminidase__InfluenzaA__ABC42841
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagccgcaaggccgacacaaaaauccucuuuaucgaggaaggcaagauuguucacaccuccacacugucugggagcgcgcaacacguggaggaaugcuccugcuauccuagauaccccggagugcggugugucugccgcgauaacuggaagggcagcaacagaccuaucguggacauuaauaucaaagacuacucuauuguuuccagcuauguguguucugggcuugucggagauacgccccggaagaacgacagcuccucuagcucccauugccuggauccgaauaacgaggaaggcggccacggggugaaaggaugggccuucgacgauggcaaugacguuuggauggggcgcaccaucagcgagaagcucagaucuggauacgagacauuuaaagugaucgaaggcugguccaacccuaauagcaagcugcagauuaaccggcaggucaucguggaucgcgggaauagaucuggauauuccggcauuuucagcgucgagggcaaauccuguaucaaccggugcuuuuacguggaacugauuagagggcgcaaggaggaaaccgagguucucuggaccucuaauagcaucguggucuucuguggaacauccggcaccuaugggacaggaucuuggcccgacggcgcugauauuaaccugaugccuaucuga

SEQ ID NO: 197660 - RNA, 1410 nt, Artificial Sequence; identical to SEQ ID NO: 197351
  derived and/or modified sequence opt5 from neuraminidase__InfluenzaA__ABC42852

SEQ ID NO: 197661 - RNA, 1410 nt, Artificial Sequence; identical to SEQ ID NO: 197351
  derived and/or modified sequence opt5 from neuraminidase__InfluenzaA__ABC42863

SEQ ID NO: 197662 - RNA, 1410 nt, Artificial Sequence; identical to SEQ ID NO: 197190
  derived and/or modified sequence opt5 from neuraminidase__InfluenzaA__ABC42874

SEQ ID NO: 197663 - RNA, 1410 nt, Artificial Sequence; identical to SEQ ID NO: 197190
  derived and/or modified sequence opt5 from neuraminidase__InfluenzaA__ABC42885

SEQ ID NO: 197664 - RNA, 1410 nt, Artificial Sequence; identical to SEQ ID NO: 197190
  derived and/or modified sequence opt5 from neuraminidase__InfluenzaA__ABC42896

SEQ ID NO: 197665 - RNA, 1410 nt, Artificial Sequence; identical to SEQ ID NO: 197615
  derived and/or modified sequence opt5 from neuraminidase__InfluenzaA__ABC42914

SEQ ID NO: 197666 - RNA, 1410 nt, Artificial Sequence; identical to SEQ ID NO: 197615
  derived and/or modified sequence opt5 from neuraminidase__InfluenzaA__ABC42932

SEQ ID NO: 197667 - RNA, 1410 nt, Artificial Sequence
  derived and/or modified sequence opt5 from neuraminidase__InfluenzaA__ABC42943
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucggguaucggaauuggagcaagccccagugcaacaucaccggauucgccccuuuuuccaaagacaauucuauucgccuuagcgcgggcggggauaucugggugacaagagagcccuacguuuccugugacccugauaagugcuaucaauucgcucugggacagggcaccacacucaacaaugggcacucuaacgacaccgugcaugaucggacgccguaccgcacacugcugaugaaugagcucggaguccccuuucaccugggcaccagacagguguguaucgccuggagcuccagcucuugccaugacggcaaggccuggcuucacguuugugugacaggggaugacaaaaacgcuaccgccuccuucauuuauaauggacggcuggucgauagcaucggcucuugguccaagaaaauucuccgcacccaggaaagcgagugcguguguaucaacgggacaugcacgguggucaugaccgacggaucugcuuccggcaaggccgauacaaaaauucuguuuaucgaagaggggaagaucguucacauuagcacccuuuccggaucugcgcaacauguggaggaaugcagcuguuacccuagauaucccggcgugcggugcgucugucgcgacaacuggaagggcuccaauagaccuaucguggauauuaacguuaaagacuacagcaucgugucuuccuacgucugcagcgggcuggugggagacacaccccggaagaaugauucuuucagcuccucucacugucucgacccgaacaaugaggaaggcgggcauggaguuaaaggcugggccuuugaugacgggaacgauguguggaugggacgcaccauuagcgagaagcugagauccggcuaugaaacguucaaagucaucgagggcuggagcaagccuaauucuaaacugcagaucaaccgccaggugauugucgagcgggggaauagauccggauacagcggcaucuuuucuguggaagggaaguccugcauuaaccgguguuucuauguugagcucaucagaggacgcaaggaagagacagaagugugguggaccagcaauuccauugucguguuuugcggcaccucugggacauacggcaccggaagcuggcccgacggcgcugauaucaaccugaugccuauuuga

SEQ ID NO: 197668 - RNA, 1410 nt, Artificial Sequence; identical to SEQ ID NO: 197615
  derived and/or modified sequence opt5 from neuraminidase__InfluenzaA__ABC42954

SEQ ID NO: 197669 - RNA, 1410 nt, Artificial Sequence; identical to SEQ ID NO: 197615
  derived and/or modified sequence opt5 from neuraminidase__InfluenzaA__ABC42965

SEQ ID NO: 197670 - RNA, 1410 nt, Artificial Sequence
  derived and/or modified sequence opt5 from neuraminidase__InfluenzaA__ABC42976
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggccaugcugugcgaacccacaaucauugagagaaauaucaccgaaauuguguaccucacaaacaccacgaucgagaaggaaauuuguccuaaacugguggaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacguucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacagagguuugguggaccagcaauuccauuguggucuuuugcggaaccucuggcacauacgggaccggcagcuggcccgacggagccgauaucaaccugaugccuauuuga

SEQ ID NO: 197671 - RNA, 1410 nt, Artificial Sequence; identical to SEQ ID NO: 197615
  derived and/or modified sequence opt5 from neuraminidase__InfluenzaA__ABC42987

SEQ ID NO: 197672 - RNA, 1410 nt, Artificial Sequence; identical to SEQ ID NO: 197615
  derived and/or modified sequence opt5 from neuraminidase__InfluenzaA__ABC42998

SEQ ID NO: 197673 - RNA, 1410 nt, Artificial Sequence; identical to SEQ ID NO: 197615
  derived and/or modified sequence opt5 from neuraminidase__InfluenzaA__ABC43009

SEQ ID NO: 197674 - RNA, 1410 nt, Artificial Sequence; identical to SEQ ID NO: 197615
  derived and/or modified sequence opt5 from neuraminidase__InfluenzaA__ABC43020

SEQ ID NO: 197675 - RNA, 1410 nt, Artificial Sequence
  derived and/or modified sequence opt5 from neuraminidase__InfluenzaA__ABC43042
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaaguccugcauuaaccgguguuucuauguugaacucaucagagggcgcaaggaggaaacagaggugugguggaccagcaauuccauugucguguuuugcggaaccucuggcacauacgggaccggcagcuggcccgacggagcugauaucaaccugauguccauuuga

SEQ ID NO: 197676 - RNA, 1410 nt, Artificial Sequence; identical to SEQ ID NO: 197615
  derived and/or modified sequence opt5 from neuraminidase__InfluenzaA__ABC43053

SEQ ID NO: 197677 - RNA, 1410 nt, Artificial Sequence
  derived and/or modified sequence opt5 from neuraminidase__InfluenzaA__ABC43064
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaaguccugcauuaaccgguguuucuauguugaacucaucagagggcgcaaggagaaaacagaagugugguggaccagcaauuccauugucguguuuugcggaaccucuggcacauacgggaccggcagcuggcccgacggagcugauaucaaccugaugccuauuuga

SEQ ID NO: 197678 - RNA, 1410 nt, Artificial Sequence; identical to SEQ ID NO: 197615
  derived and/or modified sequence opt5 from neuraminidase__InfluenzaA__ABC43075

SEQ ID NO: 197679 - RNA, 1410 nt, Artificial Sequence
  derived and/or modified sequence opt5 from neuraminidase__InfluenzaA__ABC43086
augaaccccaaucagaagaucauuaccaucggcagcgugucccugauuaucgccacaauuugcuuccucaugcaaaucgcuauccuggucacgaccguuacacuucacuuuaaacagcaugaguguaacucuccuccgaauaaccaggugaugcugugcgaacccaccauuaucgagagaaauauuacagaaaucguguaccucaccaacacaaccauugagaaggaaaucuguccuaaacuggucgaguaucggaauuggagcaagccccagugcaacauuacgggguucgccccuuuuuccaaagacaauucuauccgccuuagcgcgggaggcgauaucugggugaccagagagcccuacguuuccugugacccugauaagugcuaucaauucgcucuggggcagggaacaacccucaacaauggccacucuaacgacacagugcaugaucggaccccguaccgcacgcugcugaugaaugaacucgggguccccuuucaccugggaacaagacagguguguauugccuggagcuccagcucuugccaugacggcaaggccuggcuucacguuugugugaccggcgaugacaaaaacgcuacagccuccuucaucuauaaugggcggcuggucgauagcauuggaucuugguccaagaaaauccuccgcacccaggagagcgaaugcguguguauuaacgggaccugcacaguggucaugacggacggcucugcuuccggaaaggccgauaccaaaauccuguuuaucgaggagggcaagauuguucacaucagcacacuuuccgggucugcgcaacauguggaagagugcagcuguuacccuagauaucccggagugcggugcgucugucgcgacaacuggaagggcuccaauagaccuauuguggauaucaacguuaaagacuacagcauugugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccaucagcgaaaagcugagauccggauaugagaccuucaaagucaucgagggcuggagcaagccuaauucuaaacugcagauuaaccgccaggugaucgucgaacggggcaauagauccggguacagcggaaucuuuucuguggagggcaaguccugcauuaaccgguguuucuauguugaacucauuagagggcgcaaggaggaaacggaggugugguggacaagcaauuccaucgucguguuuugcggaaccucuggcaccuacgggacaggcagcuggcccgacggagcugauauuaaccugaugccuaucuga

SEQ ID NO: 197680 - RNA, 1410 nt, Artificial Sequence; identical to SEQ ID NO: 197615
  derived and/or modified sequence opt5 from neuraminidase__InfluenzaA__ABC43097

SEQ ID NO: 197681 - RNA, 1410 nt, Artificial Sequence; identical to SEQ ID NO: 197615
  derived and/or modified sequence opt5 from neuraminidase__InfluenzaA__ABC43108

SEQ ID NO: 197682 - RNA, 1410 nt, Artificial Sequence; identical to SEQ ID NO: 197615
  derived and/or modified sequence opt5 from neuraminidase__InfluenzaA__ABC43119

SEQ ID NO: 197683 - RNA, 1410 nt, Artificial Sequence; identical to SEQ ID NO: 197351
  derived and/or modified sequence opt5 from neuraminidase__InfluenzaA__ABC43130

SEQ ID NO: 197684 - RNA, 1410 nt, Artificial Sequence; identical to SEQ ID NO: 197351
  derived and/or modified sequence opt5 from neuraminidase__InfluenzaA__ABC43141

SEQ ID NO: 197685 - RNA, 1410 nt, Artificial Sequence; identical to SEQ ID NO: 197351
  derived and/or modified sequence opt5 from neuraminidase__InfluenzaA__ABC43152

SEQ ID NO: 197686 - RNA, 1410 nt, Artificial Sequence; identical to SEQ ID NO: 197351
  derived and/or modified sequence opt5 from neuraminidase__InfluenzaA__ABC43163

SEQ ID NO: 197687 - RNA, 1410 nt, Artificial Sequence; identical to SEQ ID NO: 197351
  derived and/or modified sequence opt5 from neuraminidase__InfluenzaA__ABC43174

SEQ ID NO: 197688 - RNA, 1410 nt, Artificial Sequence
  derived and/or modified sequence opt5 from neuraminidase__InfluenzaA__ABC43185
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacacgcauccucuuuaucgaggaagggaaaauuguucacaccuccacacugucuggaagcgcgcaacacguggaggaaugcuccugcuauccuagauaccccggcgugcggugugucugccgcgauaacuggaaggggagcaacagaccuaucguggacauuaauaucaaggacuacucuauuguuuccagcuauguguguucuggacuugucggcgauacgccccggaaaaacgacagcuccucuagcucccauugccuggauccgaauaacgaggaaggcgggcacggagugaagggcugggccuucgacgaugggaaugacguuuggaugggacgcaccaucagcgagaaacucagaucuggcuacgagacauuuaaggugaucgaagggugguccaacccuaauagcaaacugcagauuaaccggcaggucaucguggaucgcggaaauagaucuggcuauuccggcauuuucagcgucgaggggaaguccuguaucaaccggugcuuuuacguggaacugauuagaggacgcaaagaggaaaccgagguucucuggaccucuaauagcaucguggucuucuguggcacauccgggaccuauggaacaggcucuuggcccgacggggcugauauuaaccugaugccuaucuga

SEQ ID NO: 197689 - RNA, 1410 nt, Artificial Sequence; identical to SEQ ID NO: 197351
  derived and/or modified sequence opt5 from neuraminidase__InfluenzaA__ABC43478

SEQ ID NO: 197690 - RNA, 1410 nt, Artificial Sequence; identical to SEQ ID NO: 197351
  derived and/or modified sequence opt5 from neuraminidase__InfluenzaA__ABC43489

SEQ ID NO: 197691 - RNA, 1410 nt, Artificial Sequence; identical to SEQ ID NO: 197351
  derived and/or modified sequence opt5 from neuraminidase__InfluenzaA__ABC43500

SEQ ID NO: 197692 - RNA, 1410 nt, Artificial Sequence
  derived and/or modified sequence opt5 from neuraminidase__InfluenzaA__ABC43511
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaaacaaccauuaucgagagaaauauuacagaaaucguguaucugaccaacacgaccauugagaaggaaaucugccccaaacucgcugaguaccggaauugguccaagccucagugugacauuacaggguucgcccccuuuucuaaagauaacagcauccgccuguccgcgggaggcgacaucugggugaccagagagccuuaugucucuugcgaucccgacaaguguuaccaauucgcucuugggcagggaacaacccugaauaacgugcauagcaaugauacgguucacgaccggacaccuuaucgcacccuccugaugaacgaacugggcgugccguuucaucucgggacaaagcaggucugcauugccugguccucuagcuccugucacgauggaaaagccuggcugcaugugugcguuaccggcgacgauaagaaugcuaccgccagcuucaucuacaacggcagacuuguggacucuauugucuccuggagcaaagagauccugcggacacaggaaucugagugugugugcauuaaugggacguguaccguggucaugacagauggauccgcuagcggcaaggccgacaccaaaauccucuuuaucgaggaagggaagauuguucacacauccacccugucuggaagcgcgcaacacguggaggaaugcuccugcuauccccgcuacccuggcgugagaugugucugccgggauaacuggaaggggagcaaccgccccaucguggacauuaauaucaaagacuacucuauuguuuccagcuauguguguucuggacuugucggcgauacgccuagaaagaacgacagcuccucuagcucccauugccuggaucccaauaacgaggaaggcgggcacggagugaaaggcugggccuucgacgaugggaaugacguuuggaugggacggacaaucagcgagaagcuccgcucuggcuacgagaccuuuaaagugaucgaagggugguccaacccgaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggacaucuaauagcaucguggucuucuguggcaccuccgggacauauggaacgggcucuuggccugacggggcugauauuaaccugaugcccaucuga

SEQ ID NO: 197693 - RNA, 1410 nt, Artificial Sequence; identical to SEQ ID NO: 197351
  derived and/or modified sequence opt5 from neuraminidase__InfluenzaA__ABC43522

SEQ ID NO: 197694 - RNA, 1410 nt, Artificial Sequence; identical to SEQ ID NO: 197351
  derived and/or modified sequence opt5 from neuraminidase__InfluenzaA__ABC43533

SEQ ID NO: 197695 - RNA, 1410 nt, Artificial Sequence; identical to SEQ ID NO: 197351
  derived and/or modified sequence opt5 from neuraminidase__InfluenzaA__ABC43544

SEQ ID NO: 197696 - RNA, 1410 nt, Artificial Sequence; identical to SEQ ID NO: 197351
  derived and/or modified sequence opt5 from neuraminidase__InfluenzaA__ABC43555

SEQ ID NO: 197697 - RNA, 1410 nt, Artificial Sequence; identical to SEQ ID NO: 197594
  derived and/or modified sequence opt5 from neuraminidase__InfluenzaA__ABC46557

SEQ ID NO: 197698 - RNA, 1410 nt, Artificial Sequence
  derived and/or modified sequence opt5 from neuraminidase__InfluenzaA__ABC46579
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccuggauaacaaacauagcaaugacacaauucacgaucggacccccuaucgcacgcuccugaugaacgaacugggggugccuuuucaucucggaacaagacaggucuguaucgccugguccuccucuuccugccacgacggcaaggccuggcugcauguguguguuaccggccacgauaaaaaugcuacagccagcuucauuuacgacgggcggcuuguggauucuaucggauccuggagcaagaacauucugcgcacccaggagucugaaugcgucuguaucaaugggaccugcacaguggugaugacggacggcuccgcuagcgagagagccgauaccaaaauccucuuuauugaggaaggaaagaucguccacauuagcccccugucuggcagcgcgcaacauguugaggaaugcuccuguuauccucgguaccccggggugcgcugcguguguagagacaacuggaagggaagcaaucggccggucguggauaucaacguuaaagacuacucuauuguguccagcuaugucugcucuggccuugugggcgacacaccucgcaagaacgauagaagcuccucuagcuacugucggaaucccaacaaugagaaagggaaccacggaguuaagggcugggccuucgacgaugggaaugacguguggaugggacgcaccaucuccgaagagagcagaucuggcuaugagacauuuaaagucaucgggggaugguccaccccuaacagcaagcugcagauuaauagacaggugaucgucgauucugacaaccgguccggcuacagcggcauuuucuccguggaagggaaaucuugcaucaaucgcuguuuuuauguugagcucauucggggaagagaacaggagacgcgcgugugguggacaagcaacuccaucgucguguucugcggcaccucugggaccuacggaacaggcagcuggcccgauggggcugacauuaaucugaugcccaucuga

SEQ ID NO: 197699 - RNA, 1410 nt, Artificial Sequence; identical to SEQ ID NO: 197538
  derived and/or modified sequence opt5 from neuraminidase__InfluenzaA__ABC50170

SEQ ID NO: 197700 - RNA, 1410 nt, Artificial Sequence; identical to SEQ ID NO: 197538
  derived and/or modified sequence opt5 from neuraminidase__InfluenzaA__ABC50181

SEQ ID NO: 197701 - RNA, 1410 nt, Artificial Sequence; identical to SEQ ID NO: 197538
  derived and/or modified sequence opt5 from neuraminidase__InfluenzaA__ABC50192

SEQ ID NO: 197702 - RNA, 1410 nt, Artificial Sequence; identical to SEQ ID NO: 197190
  derived and/or modified sequence opt5 from neuraminidase__InfluenzaA__ABC50203

SEQ ID NO: 197703 - RNA, 1410 nt, Artificial Sequence
  derived and/or modified sequence opt5 from neuraminidase__InfluenzaA__ABC50214
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucauugauaucaacgucaaggacuacagcauugugucuuccuauguuugcagcggccuggugggggacacaccccggaaaaaugauucuuucagcuccucucauugucucgacccgaacaaugaggaaggaggccacggggucaagggaugggcuuuugaugacggcaacgauguguggauggggcgcaccaucagcgagaaacugagauccggauacgagacguucaagguuaucgaaggcuggagcaaaccuaaucccaagcugcagacaaaccgccaggugauugucgagcggggcaauagaucuggguauuccggaaucuuuagcguggaaggcaaaucuugcauuaaccgguguuucuacgucgagcucaucagagggcgcaaggaagagaccgaggugugguggaccuccaauagcauuguuguguuuugcggaacauccggcaccuaugggacaggcucuuggccugacggagccgauaucaaccugaugcccauuuga

SEQ ID NO: 197704 - RNA, 1410 nt, Artificial Sequence; identical to SEQ ID NO: 197190
  derived and/or modified sequence opt5 from neuraminidase__InfluenzaA__ABC50225

SEQ ID NO: 197705 - RNA, 1410 nt, Artificial Sequence; identical to SEQ ID NO: 197190
  derived and/or modified sequence opt5 from neuraminidase__InfluenzaA__ABC50247

SEQ ID NO: 197706 - RNA, 1410 nt, Artificial Sequence
  derived and/or modified sequence opt5 from neuraminidase__InfluenzaA__ABC50258
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucauugauaucaacgucaaggacuacagcauugugucuuccuauguuugcagcggccuggugggggacacaccccggaaaaaugauucuuucagcuccucucauugucucgacccgaacaaugaggaaggaggccacggggucaagggaugggcuuuugaugacggcaacgauguguggauggggcgcaccaucagcgagaaacugagauccggauacgagacguucaagguuaucgaaggcuggagcaaaccuaauucuaagcugcagacaaaccggcagguuauugucgagcgcggcaauagauccggguauagcggaaucuuuucuauugaaggcaaauccugcaucaaccgguguuucuacguggagcucauuagagggcgcaaggaagagaccgaggucugguggaccagcaauuccaucgugguguuuugcggaacaucuggcaccuaugggacaggcagcuggcccgacggagccgauauuaaccugaugccuaucuga

SEQ ID NO: 197707 - RNA, 1410 nt, Artificial Sequence; identical to SEQ ID NO: 197190
  derived and/or modified sequence opt5 from neuraminidase__InfluenzaA__ABC50280

SEQ ID NO: 197708 - RNA, 1410 nt, Artificial Sequence; identical to SEQ ID NO: 197190
  derived and/or modified sequence opt5 from neuraminidase__InfluenzaA__ABC50291

SEQ ID NO: 197709 - RNA, 1410 nt, Artificial Sequence
  derived and/or modified sequence opt5 from neuraminidase__InfluenzaA__ABC50302
augaaccccaaucagaagaucauuaccaucggcagcgugucccugacaauugccacgaucugcuuccucaugcaaauugcuauccugaucaccacagucacccuucacuuuaaacaguacgaguguaacucuccuccgaauaaccagguuaugcugugcgaacccacaauuaucgagagaaauauuaccgaaaucguguaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauaucugggugacaagagagcccuaugucuccugugacccugauaagugcuaccaauucgcccuggggcagggaaccacacucaacaauggccauucuaacgacaccgugcacgaucggacgccguaucgcacacugcugaugaaugaacucgggguucccuuucaucugggaaccagacagguguguauugccuggagcuccagcucuugccacgacggcaaggcuuggcuucaugucugugugacaggcgaugacgagaacgccaccgcuuccuucaucuacaaugggcggcugguugauagcauuggaucuugguccaaaaagauccuccgcacccaggaaagcgagugcguguguauuaacggcacaugcacggucgugaugaccgacgggucugccuccggaaaagcggauacaaagauccuguuuaucgaggaaggcaaaauugugcacaucagcacccuuuccgggucugcccaacacgucgaggaaugcagcuguuauccuagauaccccggaguucggugcgugugucgcgacaacuggaagggcuccaauagaccuauuguggauaucaacgucaaggacuacagcauugugucuuccuauguuugcagcggccuggugggggacacaccccggaaaaaugauucuuucagcuccucucauugucucgacccgaacaaugaggaaggaggccacggggucaagggaugggcuuuugaugacggcaacgauguguggauggggcgcaccaucagcgagaaacugagauccggauacgagacguucaagguuaucgaaggcuggagcaaaccuaauucuaagcugcagacaaaccgccaggugauugucgagcggggcaauagauccggguauagcggaaucuuuucuguggaaggcaaauccugcauuaaccgguguuucuacgucgagcucaucagagggcgcaaggaagagaccgaggugugguggaccagcaauuccauuguuguguuuugcggaacaucuggcaccuaugggacaggcagcuggcccgacggagccgauaucaaccugaugccuauuuga

SEQ ID NO: 197710 - RNA, 1410 nt, Artificial Sequence
  derived and/or modified sequence opt5 from neuraminidase__InfluenzaA__ABC50313
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacgagaacgccaccgcuuccuucauuuauaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacauguugaggaaugcagcuguuacccuagauaucccggagugcggugcgugugucgcgacaacuggaagggcuccaauagaccuaucgucgauauuaacgugaaggacuacagcaucguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccauuagcgagaaacugagauccggauaugagacguucaaggugaucgaaggcuggagcaaaccuaauucuaagcugcagacaaaccggcaggucaucguggagcgcggcaauagauccggguacagcggaaucuuuucugucgaaggcaaauccugcauuaaccgguguuucuauguggagcucauuagagggcgcaaggaagagaccgagguuugguggaccagcaauuccaucguggucuuuugcggaacaucuggcaccuacgggacaggcagcuggcccgacggagccgauauuaaccugaugccuaucuga

SEQ ID NO: 197711 - RNA, 1410 nt, Artificial Sequence; identical to SEQ ID NO: 197190
  derived and/or modified sequence opt5 from neuraminidase__InfluenzaA__ABC50324

SEQ ID NO: 197712 - RNA, 1410 nt, Artificial Sequence; identical to SEQ ID NO: 197178
  derived and/or modified sequence opt5 from neuraminidase__InfluenzaA__ABC50335

SEQ ID NO: 197713 - RNA, 1410 nt, Artificial Sequence
  derived and/or modified sequence opt5 from neuraminidase__InfluenzaA__ABC50346
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucauugauaucaacgucaaggacuacagcauugugucuuccuauguuugcagcggccuggugggggacacaccccggaaaaaugauucuuucagcuccucucauugucucgacccgaacaaugaggaaggaggccacggggucaagggaugggcuuuugaugacggcaacgauguguggauggggcgcaccaucagcgagaaacugagauccggauacgagacguucaagguuaucgaaggcuggagcaaaccuaauucuaagcugcagacaaaccgccaggugauugucgagcggggcaauagauccggguauagcggaaucuuuucuguggaaggcaaauccugcauuaaccgguguuucuacgucgagcucaucagagggcgcaaggaagagaccgaggugugguggaccagcaauuccauuguuguguuuugcggaacaucuggcaccuaugggacaggcagcuggcccgacggagccgauaucaaccugaugccuauuuga

SEQ ID NO: 197714 - RNA, 1410 nt, Artificial Sequence; identical to SEQ ID NO: 197190
  derived and/or modified sequence opt5 from neuraminidase__InfluenzaA__ABC50357

SEQ ID NO: 197715 - RNA, 1410 nt, Artificial Sequence; identical to SEQ ID NO: 197190
  derived and/or modified sequence opt5 from neuraminidase__InfluenzaA__ABC50368

SEQ ID NO: 197716 - RNA, 1410 nt, Artificial Sequence; identical to SEQ ID NO: 197190
  derived and/or modified sequence opt5 from neuraminidase__InfluenzaA__ABC50379

SEQ ID NO: 197717 - RNA, 1410 nt, Artificial Sequence; identical to SEQ ID NO: 197190
  derived and/or modified sequence opt5 from neuraminidase__InfluenzaA__ABC50390

SEQ ID NO: 197718 - RNA, 1410 nt, Artificial Sequence
  derived and/or modified sequence opt5 from neuraminidase__InfluenzaA__ABC50412
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgccugggcuacgagacauuuaaagugaucgaaggguggucuaacccuaauuccaagcugcagauuaacagacaggucaucguggaucggggaaaucgcagcggcuauucuggcauuuucuccgucgaggggaaaagcuguaucaacagaugcuuuuacguggaacucauucggggaagaaaggaggaaaccgagguucuguggaccuccaauucuaucguggucuucuguggcacaagcgggaccuauggaacaggcuccuggcccgacggggcugauauuaaccuuaugccuaucuga

SEQ ID NO: 197719 - RNA, 1410 nt, Artificial Sequence; identical to SEQ ID NO: 197718
  derived and/or modified sequence opt5 from neuraminidase__InfluenzaA__ABC50423

SEQ ID NO: 197720 - RNA, 1410 nt, Artificial Sequence; identical to SEQ ID NO: 197303
  derived and/or modified sequence opt5 from neuraminidase__InfluenzaA__ABC54671

SEQ ID NO: 197721 - RNA, 1410 nt, Artificial Sequence; identical to SEQ ID NO: 197435
  derived and/or modified sequence opt5 from neuraminidase__InfluenzaA__ABC54682

SEQ ID NO: 197722 - RNA, 1410 nt, Artificial Sequence; identical to SEQ ID NO: 197615
  derived and/or modified sequence opt5 from neuraminidase__InfluenzaA__ABC67322

SEQ ID NO: 197723 - RNA, 1410 nt, Artificial Sequence; identical to SEQ ID NO: 197190
  derived and/or modified sequence opt5 from neuraminidase__InfluenzaA__ABC67474

SEQ ID NO: 197724 - RNA, 1410 nt, Artificial Sequence; identical to SEQ ID NO: 197713
  derived and/or modified sequence opt5 from neuraminidase__InfluenzaA__ABC67546

SEQ ID NO: 197725 - RNA, 1410 nt, Artificial Sequence
  derived and/or modified sequence opt5 from neuraminidase__InfluenzaA__ABC67557
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcacgaccggacgccguaucgcacacuccugaugaacgaacugggcguccccuuucaucucgggaccaaacaggugugcaucgccugguccucuagcuccugucacgauggaaaagccuggcugcauguuugcgugacaggcgacgauaagaaugcuaccgccagcuucauuuacaacggcagacuugucgacucuaucguguccuggagcaaaaagauucugcggacccaggagucugaaugugugugcaucaaugggacauguacggucguuaugaccgauggauccgcuagcggcaaagccgacacaaagauucucuuuaucgaggaggggaagaucgugcacaccuccacacugucuggaagcgcgcaacacguggaagagugcuccugcuauccucgcuaccccggcgucagaugugugugccgggauaacuggaaagggagcaaccgcccuauuguugacaucaauauuaaggacuacucuaucguguccagcuaugucuguucuggacuugugggcgauacccccagaaagaacgacagcuccucuagcucccauugccuggauccgaauaacgaagagggcgggcacggaguuaagggcugggccuucgacgaugggaaugacguguggaugggacggacgauuagcgaaaaacuccgcucuggcuacgagacauuuaaggucaucgaggggugguccaacccuaauagcaaacugcagaucaacagacaggugauugucgaucggggaaaucgcucuggcuauuccggcaucuucagcguggaagggaaguccuguauuaacagaugcuuuuacguugagcugauccggggaagaaaggaagagaccgaagugcucuggaccucuaauagcauugucguguucuguggcacauccgggaccuauggaacaggcucuuggcccgacggggcugauaucaaccugaugccuauuuga

SEQ ID NO: 197726 - RNA, 1410 nt, Artificial Sequence
  derived and/or modified sequence opt5 from neuraminidase__InfluenzaA__ABC67568
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacauuagcccucuguccgggucugcccagcauguugaagagugcagcuguuauccccgguacccuggagugcgcugcaucuguagagauaacuggaagggcuccaaucggcccguggucgacauuaacgugaaggacuacagcaucgauucuuccuauguuugcagcggccuugugggggacacaccgcgcaacaaugauagaucuagcaacuccuacugucggaauccuaacaaugaaaaaggaaaccacggcgucaaggggugggcuuucgacgauggaaaugacguguggaugggccgcaccaucucugaggauagcagauccggguaugaaacauuuaaaguuauuggaggcuggagcacccccaacucuaagcugcagaucaauagacaggugauugucgacuccgauaaccggagcggcuacucugggaucuucuccguggagggaaaaagcugcauuaaucgcuguuuuuaugucgagcucauccggggcagagaacaagagacgcgcgugugguggacauccaacucuauuguuguguucugcgggaccagcggaaccuacggcacaggguccuggccugacggcgccaauaucaaccugaugcccaucuga

SEQ ID NO: 197727 - RNA, 1410 nt, Artificial Sequence
  derived and/or modified sequence opt5 from neuraminidase__InfluenzaA__ABC67579
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacccgccgaguaccggaauuggagcaagccucagugcaaaaucaccggguucgcgcccuuuuccaaggacaacucuauucgccugagcgcuggaggcgauaucugggucacaagagagccuuauguguccugugacccggauaagugcuaccaauucgcccuugggcagggaaccacacugaauaacggccauucuaaugacaccguucacgaucggacgcccuaucgcacacuccugaugaacgaacugggggugccuuuucaucucggaaccaaacaggucuguaucgccuggagcuccagcucuugccacgacggcaaggcuuggcugcauguguguguuacaggccacgaugagaaugccaccgcuuccuucauuuacgacgggagacuuguggauagcaucggaucuugguccaaaaagauucugcggacccaggaaagcgagugcgucuguaucaacggcacaugcacgguggugaugaccgacgggucugccuccggacgcgcggauacaaaaauucucuuuaucgaggaaggcaagaucguccacauuagccaacuguccgggucugcccagcauguugaggaaugcagcuguuaucccagauacccuggagugcggugcgugugucgcgacaauuggaagggcuccaacagacccaucgucgauauuaacgugaaagaccacagcaucguuucuuccuacgugugcagcggccuugucggggacaccccgcggaagaaugauucuagcuccucuagccauugucugaacccuaauaacgaggaaggaggccacggggugaaaggaugggcuuucgacgauggcaaugacguuuggauggggcgcacaauuuccgagaagcucagaagcggauaugagaccuuuaaagugaucgaaggcuggucuaagcccaacuccaaacugcagaucaaucggcaggucauuguggaucgcggcaacagaagcggguacucuggaaucuucuccgucgagggcaagagcugcauuaaucgguguuuuuauguggaacugaucagagggcgcaagcaagagacggaaguuugguggacauccaacucuauuguggucuucugcggaaccagcggcaccuacgggacaggcuccuggccugacggagccgauaucaaucucaugcccauuuga

SEQ ID NO: 197728 - RNA, 1410 nt, Artificial Sequence; identical to SEQ ID NO: 197351
  derived and/or modified sequence opt5 from neuraminidase__InfluenzaA__ABC67590

SEQ ID NO: 197729 - RNA, 1410 nt, Artificial Sequence; identical to SEQ ID NO: 197351
  derived and/or modified sequence opt5 from neuraminidase__InfluenzaA__ABC67601

SEQ ID NO: 197730 - RNA, 1410 nt, Artificial Sequence; identical to SEQ ID NO: 197190
  derived and/or modified sequence opt5 from neuraminidase__InfluenzaA__ABC67612

SEQ ID NO: 197731 - RNA, 1410 nt, Artificial Sequence; identical to SEQ ID NO: 197190
  derived and/or modified sequence opt5 from neuraminidase__InfluenzaA__ABC67623

SEQ ID NO: 197732 - RNA, 1410 nt, Artificial Sequence
  derived and/or modified sequence opt5 from neuraminidase__InfluenzaA__ABC67634
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgaucggacgcccuaucgcacacugcugaugaaugaacucggggugccuuuucaucugggaaccagacaggucuguaucgccuggucuagcuccagcugccacgacggcaaggcuuggcuucauguguguguuacaggcgaugacgagaacgccaccgcuucuuucauuuacaaugggcggcugguggauuccaucggaagcuggucuaaaaagauucuccgcacccaggaauccgagugcgucuguaucaacggcacaugcacgguggugaugaccgacgggagcgccucuggaaaagcggauacaaagauucuguuuaucgaggaaggcaaaaucguccacauuuccacccuuagcggguccgcccaacacguugaggaaugcucuuguuaucccagauacccuggagugcggugcgugugucgcgacaacuggaagggcagcaauagacccaucgucgauauuaacgugaaggacuacuccaucguuagcucuuaugugugcuccggccuggucggggacacaccgcggaaaaaugauagcuucucuagcucccauugucucgacccuaacaaugaggaaggaggccacggggugaagggaugggcuuuugaugacggcaacgauguuuggauggggcgcaccauuucugagaaacugagaagcggauacgagacguucaaggugaucgaaggcugguccaaacccaauagcaagcugcagacaaaccggcaggucaucguggagcgcggcaauagaucuggguauuccggaauuuuuagcgucgaaggcaaaucuugcaucaaccgguguuucuacguggagcucauuagagggcgcaaggaagagaccgagguuugguggaccuccaauagcaucguggucuuuugcggaacauccggcaccuaugggacaggcucuuggccugacggagccgauauuaaccugaugcccaucuga

SEQ ID NO: 197733 - RNA, 1410 nt, Artificial Sequence; identical to SEQ ID NO: 197190
  derived and/or modified sequence opt5 from neuraminidase__InfluenzaA__ABC67645

SEQ ID NO: 197734 - RNA, 1410 nt, Artificial Sequence; identical to SEQ ID NO: 197190
  derived and/or modified sequence opt5 from neuraminidase__InfluenzaA__ABC67656

SEQ ID NO: 197735 - RNA, 1410 nt, Artificial Sequence
  derived and/or modified sequence opt5 from neuraminidase__InfluenzaA__ABC67700
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauagcaacucuaagcugcagauuaauagacaggucaucguggaccggggaaaccgcuccggcuauagcggcauuuucuccgucgaggggaaaucuuguaucaauagaugcuuuuacguggaacugauucggggaagaaaggaggaaaccgagguucucuggaccagcaacuccaucguggucuucuguggcacaucugggaccuauggaacaggcagcuggccugauggggcugacauuaaucugaugcccaucuga

SEQ ID NO: 197736 - RNA, 1410 nt, Artificial Sequence
  derived and/or modified sequence opt5 from neuraminidase__InfluenzaA__ABC67711
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggcccgauggggcugacauuaaucugaugccuaucuga

SEQ ID NO: 197737 - RNA, 1410 nt, Artificial Sequence
  derived and/or modified sequence opt5 from neuraminidase__InfluenzaA__ABC67736
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcguggccugguccucuagcuccugucacgacggaaaagccuggcugcauguuugcgugacaggcgaugacaagaacgcuaccgccagcuucauuuacaauggcagacuugucgauucuaucguguccuggagcaaagagauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgauguguggaugggacggacgauuagcgagaagcuccgcucuggcuacgagacauuuaaagucaucgaagggugguccaauccuaacagcaagcugcagaucaauagacaggugauugucgaccggggaaaccgcucuggcuauuccggcaucuucagcguggaggggaaauccuguauuaauagaugcuuuuacguugaacugauccggggaagaaaggaggaaaccgaggugcucuggaccucuaacagcauugucguguucuguggcacauccgggaccuauggaacaggcucuuggcccgauggggcugacaucaaucugaugccuauuuga

SEQ ID NO: 197738 - RNA, 1410 nt, Artificial Sequence
  derived and/or modified sequence opt5 from neuraminidase__InfluenzaA__ABC67809
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggaccucuaauagcaucguggucuucuguggcacauccgggaccuauggaacaggcucuuggcccgacggggcugauauuaaccugaugccuaucuga

SEQ ID NO: 197739 - RNA, 1410 nt, Artificial Sequence; identical to SEQ ID NO: 197615
  derived and/or modified sequence opt5 from neuraminidase__InfluenzaA__ABC67820

SEQ ID NO: 197740 - RNA, 1410 nt, Artificial Sequence; identical to SEQ ID NO: 197594
  derived and/or modified sequence opt5 from neuraminidase__InfluenzaA__ABC67842

SEQ ID NO: 197741 - RNA, 1410 nt, Artificial Sequence; identical to SEQ ID NO: 197190
  derived and/or modified sequence opt5 from neuraminidase__InfluenzaA__ABC67853

SEQ ID NO: 197742 - RNA, 1410 nt, Artificial Sequence; identical to SEQ ID NO: 197594
  derived and/or modified sequence opt5 from neuraminidase__InfluenzaA__ABC67864

SEQ ID NO: 197743 - RNA, 1410 nt, Artificial Sequence; identical to SEQ ID NO: 197713
  derived and/or modified sequence opt5 from neuraminidase__InfluenzaA__ABC67886

SEQ ID NO: 197744 - RNA, 1410 nt, Artificial Sequence; identical to SEQ ID NO: 197190
  derived and/or modified sequence opt5 from neuraminidase__InfluenzaA__ABC67897

SEQ ID NO: 197745 - RNA, 1410 nt, Artificial Sequence; identical to SEQ ID NO: 197190
  derived and/or modified sequence opt5 from neuraminidase__InfluenzaA__ABC67970

SEQ ID NO: 197746 - RNA, 1410 nt, Artificial Sequence
  derived and/or modified sequence opt5 from neuraminidase__InfluenzaA__ABC67981
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccucaguaccccggagugagaugcgugugucgggacaacuggaagggcuccaaucgcccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggagaaccauuagcgagaaacugcgcuccggauacgagacguucaaggugaucgaaggcuggagcaaaccuaauucuaagcugcagacaaacagacaggucaucguggagcggggcaaucgcuccggguauagcggaaucuuuucugucgaaggcaaauccugcauuaacagauguuucuacguggagcucauucgggggagaaaggaagagaccgagguuugguggaccagcaauuccaucguggucuuuugcggaacaucuggcaccuaugggacaggcagcuggcccgacggagccgauauuaaccugaugccuaucuga

SEQ ID NO: 197747 - RNA, 1410 nt, Artificial Sequence
  derived and/or modified sequence opt5 from neuraminidase__InfluenzaA__ABC67992
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaauaacucuuucagcuccucucauugucucgauccgaauaacgaggaaggaggccacggggugaagggaugggcuuuugacgauggcaaugacguuuggauggggcgcaccauuagcgagaaacugagauccggauacgagacguucaaggugaucgaaggcuggagcaaaccuaacucuaagcugcagacaaaucggcaggucaucguggagcgcggcaacagauccggguauagcggaaucuuuucugucgaaggcaaauccugcauuaaucgguguuucuacguggagcucauuagagggcgcaaggaagagaucgagguuugguggaccagcaacuccauuguggucuuuugcggaaccucuggcacauaugggaccggcagcuggcccgauggagccgacaucaaucugaugccuauuuga

SEQ ID NO: 197748 - RNA, 1410 nt, Artificial Sequence; identical to SEQ ID NO: 197713
  derived and/or modified sequence opt5 from neuraminidase__InfluenzaA__ABC68003

SEQ ID NO: 197749 - RNA, 1410 nt, Artificial Sequence
  derived and/or modified sequence opt5 from neuraminidase__InfluenzaA__ABC68052
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugauugacgggucugccuccggaaaagcggauaccaagauccuguuuaucgaggaaggcaaaauuguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagaccuucaaggugaucgaaggcuggagcaaaccuaauucuaagcugcagacgaaccggcaggucauuguggagcgcggcaauagauccggguauagcggaaucuuuucugucgaaggcaaauccugcauuaaccgguguuucuacguggagcucaucagagggcgcaaggaagagacagagguuugguggaccagcaauuccauuguggucuuuugcggaaccucuggcacauaugggaccggcagcuggcccgacggagccgauaucaaccugaugccuauuuga

SEQ ID NO: 197750 - RNA, 1410 nt, Artificial Sequence; identical to SEQ ID NO: 197190
  derived and/or modified sequence opt5 from neuraminidase__InfluenzaA__ABC68063

SEQ ID NO: 197751 - RNA, 1410 nt, Artificial Sequence; identical to SEQ ID NO: 197190
  derived and/or modified sequence opt5 from neuraminidase__InfluenzaA__ABC68074

SEQ ID NO: 197752 - RNA, 1410 nt, Artificial Sequence; identical to SEQ ID NO: 197736
  derived and/or modified sequence opt5 from neuraminidase__InfluenzaA__ABC68085

SEQ ID NO: 197753 - RNA, 1410 nt, Artificial Sequence
  derived and/or modified sequence opt5 from neuraminidase__InfluenzaA__ABC68096
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcauaucaaccggcaggucauuguggagcgcggcaauagauccggguauagcggaaucuuuucugucgaaggcaaauccugcauuaaccgguguuucuacguggagcucaucagagggcgcaaggaagagacagagguuugguggaccagcaauuccauuguggucuuuugcggaaccucuggcacauaugggaccggcagcuggcccgacggagccgauaucaaccugaugccuauuuga

SEQ ID NO: 197754 - RNA, 1410 nt, Artificial Sequence
  derived and/or modified sequence opt5 from neuraminidase__InfluenzaA__ABC68225
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgaguccaagucuugcaucaacagauguuuuuacguggaacucauucggggcagaaagcaggagacagaaguucuguggaccagcaauuccaucguggucuucugcgggaccucuggaacauauggcaccgggagcuggcccgauggcgccgacauuaaccuuaugccuaucuga

SEQ ID NO: 197755 - RNA, 1410 nt, Artificial Sequence; identical to SEQ ID NO: 197543
  derived and/or modified sequence opt5 from neuraminidase__InfluenzaA__ABC68236

SEQ ID NO: 197756 - RNA, 1350 nt, Artificial Sequence
  derived and/or modified sequence opt5 from neuraminidase__InfluenzaA__ABC72646
augaaccccaauaagaaaaucauuaccaucggcagcauuugcauggugacagggauggucucccugaugcuccagaucggaaaccugauuucuaucuggguuagccacuccauccauacgggcaaucaacagaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaccuggaaugucgcaccuuuuuccuuacacagggaagccugcucaaugacaagcauucuaacggcaccgugaaagauagauccccucaccggacacugaugagcugccccgucggcgaggccccuucucccuauaauucccgcuuugaaagcguggccugguccgcuucugccugucaugacgggaccagcuggcugacgauuggaaucuccggcccugauagcggggcuguugccgugcucaaguacaacggaaucauuaccgacacaaucaaaucuuggagaaauaacauucugcggacccaggaguccgagugcgcgugugucaauggcagcugcuucacagugaugaccgaugggccgucuaacggacaagccagccacaagaucuuuaaaauggacaagggcaagguggucaaauccguugaacuugaugcucccaacuaucacuacgaggaauguucuugcuauccugacgccggcgagauuacgugugugugccgcgauaauuggcaugggagcaacagacccuggguguccuucaaucagaaccuggaguaccagaucggauauaucugcagcggcgucuuuggggacacaccucggcccaaugauggaaccggcucuugugggccgguguccagcaacggaacauacggcguuaagggcuucucuuuuaaauacgggaauggaguguggauuggccgcaccaaguccaccaacagcagauccggguucgaaaugaucugggacccuaauggauggacagagacggacucuagcuuuuccgucaaacaggauauuguggcuaucaccgacuggucuggcuauagcggguccuucguucaacaccccgaacucacaggccuggauugcauucggccuuguuucuggguggagcuuauccgcggaagacccaaggaaagcaccaucuggacaucuggcuccagcauuucuuuuugcggggucaacuccgacaccgugggauggagcuggcccgauggcgccgagcugccuuucacgaucgacaaauga

SEQ ID NO: 197757 - RNA, 1410 nt, Artificial Sequence; identical to SEQ ID NO: 197119
  derived and/or modified sequence opt5 from neuraminidase__InfluenzaA__ABC84392

SEQ ID NO: 197758 - RNA, 1410 nt, Artificial Sequence; identical to SEQ ID NO: 197533
  derived and/or modified sequence opt5 from neuraminidase__InfluenzaA__ABC84403

SEQ ID NO: 197759 - RNA, 1410 nt, Artificial Sequence; identical to SEQ ID NO: 197538
  derived and/or modified sequence opt5 from neuraminidase__InfluenzaA__ABC84414

SEQ ID NO: 197760 - RNA, 1410 nt, Artificial Sequence
  derived and/or modified sequence opt5 from neuraminidase__InfluenzaA__ABC84425
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaaaacuguaucaauagaugcuuuuacguggaacugauucggggaagaaaggaggaaaccgagguucucuggaccuccaacucuaucguggucuucuguggcacaagcgggaccuauggaacaggcuccuggcccgacggggcugauauuaaucugaugccuaucuga

SEQ ID NO: 197761 - RNA, 1410 nt, Artificial Sequence; identical to SEQ ID NO: 197351
  derived and/or modified sequence opt5 from neuraminidase__InfluenzaA__ABC84436

SEQ ID NO: 197762 - RNA, 1410 nt, Artificial Sequence
  derived and/or modified sequence opt5 from neuraminidase__InfluenzaA__ABC84447
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauugugcaucucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacgagaacgccaccgcuuccuucauuuauaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacauguugaggaaugcagcuguuacccuagauaucccggagugcggugcgugugucgcgacaacuggaagggcuccaauagaccuaucgucgauauuaacgugaaggacuacagcaucguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccauuagcgagaaacugagauccggauaugagacguucaaggugaucgaaggcuggagcaaaccuaauucuaagcugcagacaaaccggcaggucaucguggagcgcggcaauagauccggguacagcggaaucuuuucugucgaaggcaaauccugcauuaaccgguguuucuauguggagcucauuagagggcgcaaggaagagaccgagguuugguggaccagcaauuccaucguggucuuuugcggaacaucuggcaccuacgggacaggcagcuggcccgacggagccgauauuaaccugaugccuaucuga

SEQ ID NO: 197763 - RNA, 1410 nt, Artificial Sequence; identical to SEQ ID NO: 197738
  derived and/or modified sequence opt5 from neuraminidase__InfluenzaA__ABC84501

SEQ ID NO: 197764 - RNA, 1410 nt, Artificial Sequence; identical to SEQ ID NO: 197738
  derived and/or modified sequence opt5 from neuraminidase__InfluenzaA__ABC84512

SEQ ID NO: 197765 - RNA, 1410 nt, Artificial Sequence
  derived and/or modified sequence opt5 from neuraminidase__InfluenzaA__ABC84523
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuugcugauucuauuguguccuggagcaaagagauccugcggacccaggaaucugagugugucugcauuaacgggacauguacgguggugaugaccgacggauccgccagcggcaaggcggauacaaaaauccucuuuaucgaggaagggaagauuguccacaccuccacacugucuggaagcgcccaacacguugaggaaugcuccugcuauccucgcuaccccggcgugagaugugugugccgggacaacuggaaggggagcaaucgcccuaucgucgauauuaacaucaaagacuacucuauuguguccagcuauguuuguucuggacuugugggcgacacccccagaaagaaugauagcuccucuagcucccauugccuggacccgaacaaugaggaaggcgggcacggagucaaaggcugggcuuucgaugacgggaacgauguguggaugggacggacgaucagcgagaagcuccgcucuggcuacgagacauuuaaaguuaucgaagggugguccaauccuaacagcaagcugcagauuaauagacaggugaucgucgaccggggaaaccgcucuggcuauuccggcauuuucagcguggaggggaaauccuguaucaauagaugcuuuuacgucgaacugauucggggaagaaaggaggaaaccgaggugcucuggaccucuaacagcaucguuguguucuguggcacauccgggaccuauggaacaggcucuuggcccgauggggccgacauuaaucugaugccuaucuga

SEQ ID NO: 197766 - RNA, 1410 nt, Artificial Sequence
  derived and/or modified sequence opt5 from neuraminidase__InfluenzaA__ABC84545
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaaugggaccugcacaguggugaugacggauggcucugccuccggaagcgcggacaccaagauccucuuuauugaggagggcaaaaucguccacauuuccccucugucugggagcgcccagcauguugaagagugcuccuguuaucccagauacccuggagugcggugcaucugucgcgauaacuggaagggcagcaauagacccguggucgacauuaacgugaaggaccacucuaucgauuccagcuacguuugcucuggccuugugggggacacaccgcggaacaaugaucgcagcuccaacucuuauuguagaaauccuaacaaugaaaaaggaaaccauggcgucaaggggugggcuuucgacgauggaaaugacguguggaugggccggaccaucagcgaggauucccgcagcggguacgaaacauuuaaaguuauuggaggcuggucuacccccaacuccaagcugcagaucaauagacaggugauugucgacagcgauaaccggucuggcuauuccgggaucuucagcguggagggaaaauccugcauuaauagauguuuuuacgucgagcucauccgcggccgggaacaagagacgagagugugguggacaucuaacagcauuguuguguucugcgggaccuccggaaccuauggcacagggucuuggccugacggcgccgauaucaaucugaugcccaucuga

SEQ ID NO: 197767 - RNA, 1410 nt, Artificial Sequence; identical to SEQ ID NO: 197754
  derived and/or modified sequence opt5 from neuraminidase__InfluenzaA__ABC84574

SEQ ID NO: 197768 - RNA, 1410 nt, Artificial Sequence; identical to SEQ ID NO: 197754
  derived and/or modified sequence opt5 from neuraminidase__InfluenzaA__ABC85757

SEQ ID NO: 197769 - RNA, 1410 nt, Artificial Sequence; identical to SEQ ID NO: 197765
  derived and/or modified sequence opt5 from neuraminidase__InfluenzaA__ABC85768

SEQ ID NO: 197770 - RNA, 1410 nt, Artificial Sequence; identical to SEQ ID NO: 197754
  derived and/or modified sequence opt5 from neuraminidase__InfluenzaA__ABC85779

SEQ ID NO: 197771 - RNA, 1410 nt, Artificial Sequence; identical to SEQ ID NO: 197754
  derived and/or modified sequence opt5 from neuraminidase__InfluenzaA__ABC85790

SEQ ID NO: 197772 - RNA, 1410 nt, Artificial Sequence; identical to SEQ ID NO: 197738
  derived and/or modified sequence opt5 from neuraminidase__InfluenzaA__ABC85801

SEQ ID NO: 197773 - RNA, 1410 nt, Artificial Sequence; identical to SEQ ID NO: 197738
  derived and/or modified sequence opt5 from neuraminidase__InfluenzaA__ABC85812

SEQ ID NO: 197774 - RNA, 1410 nt, Artificial Sequence; identical to SEQ ID NO: 197765
  derived and/or modified sequence opt5 from neuraminidase__InfluenzaA__ABC85823

SEQ ID NO: 197775 - RNA, 1410 nt, Artificial Sequence; identical to SEQ ID NO: 197737
  derived and/or modified sequence opt5 from neuraminidase__InfluenzaA__ABC85834

SEQ ID NO: 197776 - RNA, 1410 nt, Artificial Sequence; identical to SEQ ID NO: 197738
  derived and/or modified sequence opt5 from neuraminidase__InfluenzaA__ABC85845

SEQ ID NO: 197777 - RNA, 1410 nt, Artificial Sequence; identical to SEQ ID NO: 197765
  derived and/or modified sequence opt5 from neuraminidase__InfluenzaA__ABC85856

SEQ ID NO: 197778 - RNA, 1410 nt, Artificial Sequence; identical to SEQ ID NO: 197737
  derived and/or modified sequence opt5 from neuraminidase__InfluenzaA__ABC85867

SEQ ID NO: 197779 - RNA, 1410 nt, Artificial Sequence; identical to SEQ ID NO: 197736
  derived and/or modified sequence opt5 from neuraminidase__InfluenzaA__ABC85900

SEQ ID NO: 197780 - RNA, 1410 nt, Artificial Sequence
  derived and/or modified sequence opt5 from neuraminidase__InfluenzaA__ABC85911
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauauguggauggggcgcaccauuagcgagaaacugagauccggauacgagacguucaagguuaucgaaggcuggagcaaaccuaauucuaagcugcagacaaaccgccaggugaucgucgagcggggcaauagauccggguauagcggaaucuuuucuguggaaggcaaauccugcauuaaccgguguuucuacgucgagcucauuagagggcgcaaggaagagaccgaggugugguggaccagcaauuccaucguuguguuuugcggaacaucuggcaccuaugggacaggcagcuggcccgacggagccgauauuaaccugaugccuaucuga

SEQ ID NO: 197781 - RNA, 1410 nt, Artificial Sequence
  derived and/or modified sequence opt5 from neuraminidase__InfluenzaA__ABC85922
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaccaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacucugauaagugcuaccaauucgcccuggggcagggaacaacccucaacaauggccauagcaacgacacgguucacgaucggacaccuuaucgcacccugcugaugaaugaacucggggugccguuucaucugggaacaagacaggucuguaucgccugguccuccucuuccugccacgacggcaaggcuuggcuucauguguguguuaccggcgaugacgagaacgccaccgcuagcuucaucuacaaugggcggcugguggauucuauuggauccuggagcaaaaagauccuccgcacacaggaaucugagugcgucuguauuaacggcacgugcaccguggugaugacagacggguccgccagcggaaaagcggauaccaagauccuguuuauugaggaaggcaaaaucguccacaucuccacacuuucugggagcgcccaacacguugaggaaugcuccuguuaucccagauacccuggagugcggugcgugugucgcgacaacuggaagggcagcaauagacccauugucgauaucaacgugaaggacuacucuauuguuuccagcuaugugugcucuggccuggucggggacaccccucggaaaaaugauagcuucuccucuagccauugucucgaccccaacaaugaggaaggaggccacggggugaagggaugggcuuuugaugacggcaacgauguuuggauggggcgcacgaucuccgagaaacugagaagcggauacgagacauucaaggugauugaaggcuggucuaaaccgaauagcaagcugcagaccaaccggcaggucaucguggagcgcggcaauagaagcggguauucuggaaucuuuuccgucgaaggcaaaagcugcauuaaccgguguuucuacguggagcucaucagagggcgcaaggaagagaccgagguuugguggacauccaauucuauuguggucuuuugcggaaccagcggcacauaugggacgggcuccuggccugacggagccgauaucaaccugaugcccauuuga

SEQ ID NO: 197782 - RNA, 1410 nt, Artificial Sequence; identical to SEQ ID NO: 197190
  derived and/or modified sequence opt5 from neuraminidase__InfluenzaA__ABC85933

SEQ ID NO: 197783 - RNA, 1410 nt, Artificial Sequence
  derived and/or modified sequence opt5 from neuraminidase__InfluenzaA__ABC85955
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagacaaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccggaugccuaucuga

SEQ ID NO: 197784 - RNA, 1410 nt, Artificial Sequence; identical to SEQ ID NO: 197190
  derived and/or modified sequence opt5 from neuraminidase__InfluenzaA__ABC85966

SEQ ID NO: 197785 - RNA, 1410 nt, Artificial Sequence; identical to SEQ ID NO: 197190
  derived and/or modified sequence opt5 from neuraminidase__InfluenzaA__ABC85977

SEQ ID NO: 197786 - RNA, 1410 nt, Artificial Sequence
  derived and/or modified sequence opt5 from neuraminidase__InfluenzaA__ABC85988
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggggauuuguccuaaacuggccgaauaccggaauuggagcaagccccagugcaacaucaccggauucgcgccuuuuuccaaagacaauucuauucgccuuagcgcuggcggggauaucugggucacaagagagcccuauguguccugugacccugauaagugcuaccaauucgcccugggacagggcaccacacucaacaaugggcauucuaacgacaccguucacgaucggacgccguaucgcacacugcugaugaaugagcucggagugcccuuucaucugggcaccagacaggucuguaucgccuggagcuccagcucuugccacgacggcaaggcuuggcuucauguguguguuacaggggaugacgaaaacgccaccgcuuccuucauuuacaauggacggcugguggauagcaucggcucuugguccaaaaagauucuccgcacccaggagagcgaaugcgucuguaucaacgggacaugcacgguggugaugaccgacggaucugccuccggcaaagcggauacaaagauucuguuuaucgaggaggggaaaaucguccacauuagcacccuuuccggaucugcccaacacguugaagagugcagcuguuauccuagauaccccggcgugcggugcgugugucgcgacaacuggaagggcuccaauagaccuaucgucgauauuaacgugaaggacuacagcaucguuucuuccuaugugugcagcgggcuggucggagacacaccccggaaaaaugauucuuucagcuccucucauugucucgacccgaacaaugaagagggcgggcacggagugaagggcugggcuuuugaugacgggaacgauguuuggaugggacgcaccauuagcgaaaaacugagauccggcuacgagacguucaaggugaucgagggcuggagcaaaccuaauucuaagcugcagacaaaccggcaggucaucguggaacgcgggaauagauccggauauagcggcaucuuuucugucgaggggaaauccugcauuaaccgguguuucuacguggaacucauuagaggacgcaaggaggaaaccgagguuugguggaccagcaauuccaucguggucuuuugcggcacaucugggaccuauggcacaggaagcuggcccgacggcgccgauauuaaccugaugccuaucuga

SEQ ID NO: 197787 - RNA, 1410 nt, Artificial Sequence; identical to SEQ ID NO: 197351
  derived and/or modified sequence opt5 from neuraminidase__InfluenzaA__ABC85999

SEQ ID NO: 197788 - RNA, 1410 nt, Artificial Sequence; identical to SEQ ID NO: 197351
  derived and/or modified sequence opt5 from neuraminidase__InfluenzaA__ABC86010

SEQ ID NO: 197789 - RNA, 1410 nt, Artificial Sequence
  derived and/or modified sequence opt5 from neuraminidase__InfluenzaA__ABC86021
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcuaacauuaaucugaugccuaucuga

SEQ ID NO: 197790 - RNA, 1410 nt, Artificial Sequence; identical to SEQ ID NO: 197615
  derived and/or modified sequence opt5 from neuraminidase__InfluenzaA__ABC86127

SEQ ID NO: 197791 - RNA, 1410 nt, Artificial Sequence; identical to SEQ ID NO: 197698
  derived and/or modified sequence opt5 from neuraminidase__InfluenzaA__ABC86140

SEQ ID NO: 197792 - RNA, 1410 nt, Artificial Sequence; identical to SEQ ID NO: 197508
  derived and/or modified sequence opt5 from neuraminidase__InfluenzaA__ABC86151

SEQ ID NO: 197793 - RNA, 1413 nt, Artificial Sequence
  derived and/or modified sequence opt5 from neuraminidase__InfluenzaA__ABC86240
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagaaaauuaucaccuaugagaauagaacaugggucaaccaaaccuacguuaauaucaacaauacaaacgugguggccggaaaggacaaaaccuccaugacacuggcgggcaauucuagccuuuguccuauucgggggugggcuaucuauaccaaggauaacuccauucgcaucggaagcaaaggcgacgucuucgugauuagagaaccguuuaucucuugcucccaucuggagugucggacguucuuucucacccagggcgcccugcuuaaugauaagcacagcaacgggacaaucaaggaccgcucucccuucagagcccugauguccugcccucucggagaagcucccagcccuuacaauucucgguuugaguccguugccuggagcgcuuccgccugucaugauggccugggguggcugaccauuggaaucucuggccccgacaacggggcgguggccguccucaaauauaacggaauuaucacagaaaccauuaagagcuggaaaaagcagauccugcgcacgcaggaguccgagugcguguguguuaauggcagcugcuucacaaucaugaccgauggcccuucuaacagagcugccuccuaccggauuuuuaaaaucgaaaaggggcgcgugacaaagagcauugagcuugacgcuccgaauuaucacuacgaagaguguucuugcuaccccgauaccggaaccgucaugugugugugcagagacaacuggcauggcagcaaucggccuuggguguccuucaaccaaaaucuggauuaucagaucggguacauuugcucuggagucuuuggcgacaacccccgcccuaaagauggggagggaagcuguaaucccguuacaguggacggcgccgacggcgugaagggguucuccuauagauacggaaacggcgucuggaucgggcggacgaaaagcaaucgccucagaaagggauuugaaaugauuugggauccgaacggcuggaccgacacagauucugacuucuccaugaaacaggaugugguugcgaugaccgacuggagcggguauucuggcuccuuugugcagcacccugagcugacaggacuugauugcaugcggcccuguuucugggucgaacuggugagaggccucccucgcgagaauaccacgaucuggacaagcggguccucuaucagcuucugcggaguuaacuccgaaaccgccaauuggucuuggcccgacggcgcugagcugcccuuuaccauugauaaguga

SEQ ID NO: 197794 - RNA, 1410 nt, Artificial Sequence
  derived and/or modified sequence opt5 from neuraminidase__InfluenzaA__ABC97377
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaaugggaccugcacaguggugaugacggauggcucugccuccggaagcgcggacaccaagauccucuuuauugaggagggcaaaaucguccacauuuccccucugucugggagcgcccagcauguugaagagugcuccuguuaucccagauacccuggagugcggugcaucugucgcgauaacuggaagggcagcaauagacccguggucgacauuaacgugaaggacuacucuaucgauuccagcuauguuugcucuggccuugugggggacacaccgcggaacaaugaucgcagcuccaacucuuacuguagaaauccuaacaaugaaaaaggaaaccacggcgucaaggggugggcuuucgacgauggaaaugacguguggaugggccggaccaucagcgaggauucccgcagcggguaugaaacauuuaaaguuauuggaggcuggucuacccccaacuccaagcugcagaucaauagacaggugauugucgacagcgauaaccggucuggcuacuccgggaucuucagcguggagggaaaauccugcauuaauagauguuuuuaugucgagcucauccgcggccgggaacaagagacgagagugugguggacaucuaacagcauuguuguguucugcgggaccuccggaaccuacggcacagggucuuggccugacggcgccgauaucaaucugaugcccaucuga

SEQ ID NO: 197795 - RNA, 1410 nt, Artificial Sequence; identical to SEQ ID NO: 197161
  derived and/or modified sequence opt5 from neuraminidase__InfluenzaA__ABD15452

SEQ ID NO: 197796 - RNA, 1410 nt, Artificial Sequence; identical to SEQ ID NO: 197249
  derived and/or modified sequence opt5 from neuraminidase__InfluenzaA__ABD15463

SEQ ID NO: 197797 - RNA, 1410 nt, Artificial Sequence; identical to SEQ ID NO: 197169
  derived and/or modified sequence opt5 from neuraminidase__InfluenzaA__ABD15474

SEQ ID NO: 197798 - RNA, 1410 nt, Artificial Sequence
  derived and/or modified sequence opt5 from neuraminidase__InfluenzaA__ABD15485
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacguucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacagagguuugguggaccagcaauuccauuguggucuuuugcggaaccucuggcacauacgggaccggcagcuggcccgacggagccaacaucaaucugaugccuauuuga

SEQ ID NO: 197799 - RNA, 1410 nt, Artificial Sequence; identical to SEQ ID NO: 197249
  derived and/or modified sequence opt5 from neuraminidase__InfluenzaA__ABD15496

SEQ ID NO: 197800 - RNA, 1410 nt, Artificial Sequence; identical to SEQ ID NO: 197169
  derived and/or modified sequence opt5 from neuraminidase__InfluenzaA__ABD15507

SEQ ID NO: 197801 - RNA, 1413 nt, Artificial Sequence
  derived and/or modified sequence opt5 from neuraminidase__InfluenzaA__ABD15518
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacgggggagcuagcuacaaaaucuucaagauugaaaagggcaaagucacaaaguccaucgagcugaaugccccuaacuuucacuaugaagaguguucuugcuacccggacaccgggaccgugaugugugugugccgcgauaauuggcacggaagcaacagacccugggucuccuucaaucagaaccuugacuaccagauuggcuauaucugcagcgggguuuuuggagauaauccucggcccaaagacggcaagggcucuuguaacccugugacaguggauggggcugacggagucaaaggcuucuccuacaaguaugggaauggaguguggauuggccgcacgaaaagcaacagacugcggaagggguuugagaugaucugggaccccaauggcuggaccgauacagacucugauuucuccguuaagcaagacguggucgccauuaccgauuggagcggauacuccggcucuuuugugcagcauccggaacucacagggcuggacugcauccgcccuuguuucuggguugagcuugugagaggacugccccgggaaaacaccacgaucuggacaagcggcuccucuauuagcuucugcggggucgauuccgacaccgcgaauuggagcuggccugauggagccgagcuccccuuuaccaucgacaaauga

SEQ ID NO: 197802 - RNA, 1410 nt, Artificial Sequence; identical to SEQ ID NO: 197351
  derived and/or modified sequence opt5 from neuraminidase__InfluenzaA__ABD15529

SEQ ID NO: 197803 - RNA, 1410 nt, Artificial Sequence; identical to SEQ ID NO: 197538
  derived and/or modified sequence opt5 from neuraminidase__InfluenzaA__ABD15551

SEQ ID NO: 197804 - RNA, 1410 nt, Artificial Sequence
  derived and/or modified sequence opt5 from neuraminidase__InfluenzaA__ABD15562
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgauugugaugaccgacggcuccgccagcgggagagcggauacaaaaauccuguuuaucgaggaaggaaagauugugcacaucuccccucuuucuggcagcgcccaacaugucgaggaaugcuccuguuauccccgguacccugggguucgcugcguguguagagacaacuggaagggaagcaaucggcccauuguggauaucaacgucaaagacuacucuauuguguccagcuauguuugcucuggccuggugggcgacaccccgcgcaagaacgauagcuccucuagcucccacugucucaauccuaacaaugaggaagggggacauggcgucaaagggugggcuuucgacgauggaaacgacguguggaugggcagaacaaucagcgagaaguuucggucuggguacgagaccuucaaaguuaucgaaggaugguccaagcccaauagcaaacugcagauuaaccgccaggugaucgucgauagaggcaaucggucuggcuauuccgggauuuuuagcguggagggaaaguccugcaucaacagauguuucuacgucgaacugauucgcggccggaagcaggagacggaagugugguggacaucuaauagcaucguuguguuuugcgggaccuccggaaccuauggcacagggucuuggccugacggcgccgauauuaaccucaugcccaucuga

SEQ ID NO: 197805 - RNA, 1410 nt, Artificial Sequence
  derived and/or modified sequence opt5 from neuraminidase__InfluenzaA__ABD15573
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaacggccauucuaaugacaccguucacgaucggacgccguaucgcacacugcugaugaacgaacucggggugcccuuucaucugggaaccaaacaggucuguauggccuggagcuccagcucuugccacgacggcaaggcuuggcuucauguguguguuacaggccacgaugagaaugccaccgcuuccuucaucuacgacgggagacugguggauagcauuggaucuugguccaaaaagauccuccggacccaggaaagcgagugcgucuguauuaacggcacaugcacgguggugaugaccgacgggucugccuccggacgcgcggauacaaaaauccuguuuauugaggaaggcaagaucguccacaucagccaacuuuccgggucugcccagcauguugaggaaugcagcuguuauccuagauaccccggagugcggugcgugugucgcgacaauuggaagggcuccaacagaccuauugucgauaucaacgugaaagaccacagcauuguuucuuccuacgugugcagcggccuggucggggacacaccccggaagaaugauucuagcuccucuagccauugucucaacccgaauaacgaggaaggaggccacggggugaaaggaugggcuuucgacgauggcaaugacguuuggauggggcgcaccaucuccgagaagcugagaagcggauaugagaccuuuaaagugauugaaggcuggucuaagccuaacuccaaacugcagaucaaucggcaggucaucguggaucgcggcaacagaagcggguacucuggaauuuucuccgucgagggcaagagcugcaucaaucgguguuuuuauguggaacucauuagagggcgcaagcaagagacggaaguuugguggacauccaacucuaucguggucuucugcggaaccagcggcaccuacgggacaggcuccuggcccgacggagccgauauuaaucugaugccuaucuga

SEQ ID NO: 197806 - RNA, 1410 nt, Artificial Sequence
  derived and/or modified sequence opt5 from neuraminidase__InfluenzaA__ABD15584
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugauaagugcuaccaauucgcccuggggcagggaaccacacucaacaaucggcauagcaacgacaccguucacgaucgcacgccguauagaacacugcugaugaaugaacucggcgugcccuuucaucuggggaccaaacaggucuguaucgccugguccucuagcuccugccacgacggaaaggcuuggcuucauguguguguuacaggccacgaugagaacgccaccgcuagcuucauuuacgacggccggcugguggauucuaucggguccuggagcaaaaagauucuccgcacccaggaaucugagugcgucuguaucaauggaacaugcacgguggugaugaccgacggcuccgccagcgggagagcggauacaaaaauucuguuuaucgaggaaggaaagaucguccacauuuccccucuuucuggcagcgcccaacauguugaggaaugcuccuguuauccccgguacccuggggugcgcugcguguguagagacaacuggaagggaagcaaucggcccaucgucgauauuaacgugaaagacuacucuaucguuuccagcuaugugugcucuggccuggucggcgacaccccgcgcaagaacgauagcuccucuagcucccacugucucaauccuaacaaugaggaagggggacauggcgugaaagggugggcuuucgacgaugagaacgacguuuggaugggaagaacaauuagcgagaaguuucggucuggcuacgaaaccuucaaagugaucgaggggugguccaagcccaauagcaaacugcagaucaaccgccaggucauuguggauagaggaaaucggucuggcuauuccggcaucuuuagcgucgaagggaaguccugcauuaacagauguuucuacguggagcugauccgcggacggaagcaggaaacggagguuugguggacaucuaauagcauuaucguguuuugcggcaccuccgggaccuauggaacaggcucuuggccugacggggccgauauuaaccucaugcccaucuga

SEQ ID NO: 197807 - RNA, 1410 nt, Artificial Sequence; identical to SEQ ID NO: 197538
  derived and/or modified sequence opt5 from neuraminidase__InfluenzaA__ABD15595

SEQ ID NO: 197808 - RNA, 1410 nt, Artificial Sequence; identical to SEQ ID NO: 197538
  derived and/or modified sequence opt5 from neuraminidase__InfluenzaA__ABD15606

SEQ ID NO: 197809 - RNA, 1410 nt, Artificial Sequence; identical to SEQ ID NO: 197538
  derived and/or modified sequence opt5 from neuraminidase__InfluenzaA__ABD15617

SEQ ID NO: 197810 - RNA, 1410 nt, Artificial Sequence; identical to SEQ ID NO: 197597
  derived and/or modified sequence opt5 from neuraminidase__InfluenzaA__ABD15639

SEQ ID NO: 197811 - RNA, 1410 nt, Artificial Sequence; identical to SEQ ID NO: 197754
  derived and/or modified sequence opt5 from neuraminidase__InfluenzaA__ABD15650

SEQ ID NO: 197812 - RNA, 1410 nt, Artificial Sequence; identical to SEQ ID NO: 197277
  derived and/or modified sequence opt5 from neuraminidase__InfluenzaA__ABD15661

SEQ ID NO: 197813 - RNA, 1410 nt, Artificial Sequence; identical to SEQ ID NO: 197754
  derived and/or modified sequence opt5 from neuraminidase__InfluenzaA__ABD15683

SEQ ID NO: 197814 - RNA, 1410 nt, Artificial Sequence; identical to SEQ ID NO: 197277
  derived and/or modified sequence opt5 from neuraminidase__InfluenzaA__ABD15694

SEQ ID NO: 197815 - RNA, 1410 nt, Artificial Sequence; identical to SEQ ID NO: 197754
  derived and/or modified sequence opt5 from neuraminidase__InfluenzaA__ABD15705

SEQ ID NO: 197816 - RNA, 1410 nt, Artificial Sequence; identical to SEQ ID NO: 197754
  derived and/or modified sequence opt5 from neuraminidase__InfluenzaA__ABD15727

SEQ ID NO: 197817 - RNA, 1410 nt, Artificial Sequence
  derived and/or modified sequence opt5 from neuraminidase__InfluenzaA__ABD15749
augaaccccaaucagaagaucauuaccaucggcagcgugucccugacaauugccacgaucugcuuccucaugcaaauugcuguccugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggcuuggcuucauguuugugugacaggcgaugacgagaacgccaccgcuuccuucaucuacaaugggagacuggucgauagcauuggaucuugguccaagaaaauccuccggacccaggaaagcgagugcguguguauuaacggcacaugcacgguggucaugaccgacgggucugccuccggaaaggcggauacaaaaauccuguuuauugaggaaggcaagaucguucacaccagccuucuguccgggucugcccaacacguggaggaaugcagcuguuauccucgcuaccccggagugagaugcgucugucgggacaacuggaagggcuccaaucgcccuaucguggauauuaacguuaaagacuacagcaucgugucuuccuaugucugcagcggccucgugggggacacacccagaaagaaugauucuagcuccucuagccauugucuggacccgaacaaugaggaaggaggccacgggguuaaaggaugggcuuucgaugacggcaacgauguguggauggggcggaccauuuccgagaagcugcgcagcggauacgagacguuuaaagucaucgaaggcuggucuaagccuaauuccaaacuccagauuaacagacaggugaucgucgaccggggcaaucgcagcggguauucuggaaucuucuccguggagggcaagagcugcauuaacagauguuuuuacguugaacugauccgggggagaaagcaggagacagaagugcuuuggaccuccaauucuauugucguguucugcggaaccagcggcacauaugggaccggcuccuggcccgauggagccgacaucaaccugaugccuauuuga

SEQ ID NO: 197818 - RNA, 1410 nt, Artificial Sequence; identical to SEQ ID NO: 197817
  derived and/or modified sequence opt5 from neuraminidase__InfluenzaA__ABD15760

SEQ ID NO: 197819 - RNA, 1410 nt, Artificial Sequence; identical to SEQ ID NO: 197754
  derived and/or modified sequence opt5 from neuraminidase__InfluenzaA__ABD15771

SEQ ID NO: 197820 - RNA, 1410 nt, Artificial Sequence; identical to SEQ ID NO: 197754
  derived and/or modified sequence opt5 from neuraminidase__InfluenzaA__ABD15782

SEQ ID NO: 197821 - RNA, 1410 nt, Artificial Sequence; identical to SEQ ID NO: 197754
  derived and/or modified sequence opt5 from neuraminidase__InfluenzaA__ABD15793

SEQ ID NO: 197822 - RNA, 1410 nt, Artificial Sequence; identical to SEQ ID NO: 197738
  derived and/or modified sequence opt5 from neuraminidase__InfluenzaA__ABD16306

SEQ ID NO: 197823 - RNA, 1410 nt, Artificial Sequence
  derived and/or modified sequence opt5 from neuraminidase__InfluenzaA__ABD16317
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucgggaucgcacgccguauagaacacuccugaugaaugaacugggcgugcccuuucaccucgggaccaagcaggucugcauugccugguccucuagcuccugucaugacggaaaagccuggcugcacgugugcguuacaggcgaugacaagaacgcuaccgccagcuucaucuacaauggccggcuuguggauucuauugucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagacuacucuauuguuuccagcuauguguguucuggacuugucggcgacacgccccggaagaaugauagcuccucuagcucccacugccuggacccgaacaaugaggaaggcgggcauggagugaaaggcugggccuucgaugacgggaacgauguuuggaugggacgcaccaucagcgagaagcucagaucuggcuacgagacauuuaaagugaucgaagggugguccaauccuaacagcaagcugcagauuaaucggcaggucaucguggaccgcggaaacagaucuggcuauuccggcauuuucagcgucgaggggaaauccuguaucaaucggugcuuuuacguggaacugauuagaggacgcaaggaggaaaccgagguucucuggaccucuaacagcaucguggucuucuguggcacauccgggaccuauggaacaggcucuuggcccgauggggcugacauuaaucugaugccuaucuga

SEQ ID NO: 197824 - RNA, 1410 nt, Artificial Sequence; identical to SEQ ID NO: 197738
  derived and/or modified sequence opt5 from neuraminidase__InfluenzaA__ABD16328

SEQ ID NO: 197825 - RNA, 1410 nt, Artificial Sequence
  derived and/or modified sequence opt5 from neuraminidase__InfluenzaA__ABD16339
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcggccauugccuggauccgaauaacgaagaagggggacacggcgugaaagggugggccuucgacgauggaaaugacguuuggaugggccggacgaucuccgagaaacuccgcagcggguacgagacauuuaaggugaucgagggauggucuaacccuaauuccaaacugcagauuaacagacaggucaucguggaucggggcaaucgcagcggcuauucugggauuuucuccgucgaaggaaagagcuguaucaacagaugcuuuuacguggagcugauucggggcagaaaggaagagaccgaaguucucuggaccuccaauucuaucguggucuucugugggacaagcggaaccuauggcacaggguccuggcccgacggcgcugauauuaaccugaugccuaucuga

SEQ ID NO: 197826 - RNA, 1410 nt, Artificial Sequence
  derived and/or modified sequence opt5 from neuraminidase__InfluenzaA__ABD16361
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcaaacuuguggacucuauugucuccuggagcaagaaaauccugagaacccaggagucugaaugugugugcauuaaugggacauguacgguggucaugaccgauggauccgcuagcggcaaggccgacacaaagauccucuuuaucgaggaggggaaaauuguucacaccuccacacugucuggaagcgcgcaacacguggaagagugcuccugcuauccucgguaccccggcgugcgcugugucugcagagauaacuggaaggggagcaaccggccuaucguggacauuaauaucaaagacuacucuauuguuuccagcuauguguguucuggacuugucggcgauacgccccgcaagaacgacagcuccucuagcucccauugccuggauccgaauaacgaagagggcgggcacggagugaaaggcugggccuucgacgaugggaaugacguuuggaugggaagaaccaucagcgaaaagcuccggucuggcuacgagacauuuaaagugaucgaggggugguccaacccuaauagcaagcugcagauuaaccgccaggucaucguggauagaggaaaucggucuggcuauuccggcauuuucagcgucgaagggaaguccuguaucaaccgcugcuuuuacguggagcugauuagaggacggaaagaagagaccgaaguucucuggaccucuaauagcaucguggucuucuguggcacauccgggaccuauggaacaggcucuuggcccgacggggcugauauuaaccugaugccuaucuga

SEQ ID NO: 197827 - RNA, 1410 nt, Artificial Sequence; identical to SEQ ID NO: 197738
  derived and/or modified sequence opt5 from neuraminidase__InfluenzaA__ABD16475

SEQ ID NO: 197828 - RNA, 1410 nt, Artificial Sequence; identical to SEQ ID NO: 197738
  derived and/or modified sequence opt5 from neuraminidase__InfluenzaA__ABD16486

SEQ ID NO: 197829 - RNA, 1410 nt, Artificial Sequence; identical to SEQ ID NO: 197765
  derived and/or modified sequence opt5 from neuraminidase__InfluenzaA__ABD16497

SEQ ID NO: 197830 - RNA, 1410 nt, Artificial Sequence; identical to SEQ ID NO: 197738
  derived and/or modified sequence opt5 from neuraminidase__InfluenzaA__ABD16508

SEQ ID NO: 197831 - RNA, 1410 nt, Artificial Sequence
  derived and/or modified sequence opt5 from neuraminidase__InfluenzaA__ABD16519
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaaugugugugcauuaaugggacauguacgguggucaugaccgacggauccgcuagcggcaaggccgauacaaaaauccucuuuaucgaggaggggaagauuguucacaccuccacacugucuggaagcgcgcaacacguggaagagugcuccugcuauccucgcuaccccggcgugagaugugucugccgggacaacuggaaggggagcaaccgcccuaucguggacauuaauaucaaagauuacucuauuguuuccagcuauguguguucuggacuugucggcgacacccccagaaagacggauagcuccucuagcucccauugccuggacccgaacaaugaagagggcgggcacggagugaaaggcugggccuucgaugacgggaacgauguuuggaugggacggacaaucagcgaaaagcuccgccugggcuacgagaccuuuaaagugaucgagggguggucuaauccuaacuccaagcugcagauuaauagacaggucaucguggaccggggaaaccgcagcggcuauucuggcauuuucuccgucgaagggaaaagcuguaucaauagaugcuuuuacguggagcucauucggggaagaaaggaagagaccgaaguucuguggacauccaacucuaucguggucuucuguggcaccagcgggacauauggaacgggcuccuggcccgauggggcugacauuaaucuuaugccuaucuga

SEQ ID NO: 197832 - RNA, 1410 nt, Artificial Sequence
  derived and/or modified sequence opt5 from neuraminidase__InfluenzaA__ABD16530
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaagcggugcauuaacagauguuucuauguugaacucauccgcgggcggaaggaggaaacagaggugugguggaccuccaauagcauugucguguuuugcggaaccuccggcacauacgggaccggcucuuggcccgacggagcugauaucaaccugaugccuauuuga

SEQ ID NO: 197833 - RNA, 1410 nt, Artificial Sequence; identical to SEQ ID NO: 197615
  derived and/or modified sequence opt5 from neuraminidase__InfluenzaA__ABD16541

SEQ ID NO: 197834 - RNA, 1410 nt, Artificial Sequence; identical to SEQ ID NO: 197738
  derived and/or modified sequence opt5 from neuraminidase__InfluenzaA__ABD16552

SEQ ID NO: 197835 - RNA, 1410 nt, Artificial Sequence; identical to SEQ ID NO: 197737
  derived and/or modified sequence opt5 from neuraminidase__InfluenzaA__ABD16563

SEQ ID NO: 197836 - RNA, 1410 nt, Artificial Sequence
  derived and/or modified sequence opt5 from neuraminidase__InfluenzaA__ABD16574
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacgagaacgcuaccgccagcuucauuuacgaugggcggcuugucgacucuaucggauccuggagcaaaaauauucugcgcacccaggaaucugagugcguguguaucaacggcacaugcacgguggucaugaccgauggguccgcuagcgagagagccgacacaaagauucucuuuaucgaagagggaaaaaucguucacauuagcccccugucuggcagcgcgcaacauguggaagagugcuccuguuauccucgguaccccggggugcgcugcgucuguagagauaauuggaagggaagcaaccggccgaucguggacauuaacguuaaggauuacucuaucguguccagcuaugucugcucuggccuugugggcgacaccccucgcaaaaaugacagaagcuccucuagcuacugucggaaccccaauaacgaaaaggggucccacggaguuaaaggcugggccuucgaugacgggaaugauguguggaugggacgcacaauuggcgaggagcugagaagcggguaugaaaccuuuaaggucaucggaggcuggucuacgccuaacuccaaacuccagaucaauagacaggugauugucgacagcggcaacagaucuggguacuccggaaucuucagcguggagggcaaguccugcauuaaucgcuguuuuuauguugaacugauccgggggcggaaaaaggagacacgcgugugguggaccucuaacagcauugucguguucugcggaaccuccggcacauacgggaccggcucuuggcccgauggagcugacaucaaucugaugcccauuuga

SEQ ID NO: 197837 - RNA, 1410 nt, Artificial Sequence
  derived and/or modified sequence opt5 from neuraminidase__InfluenzaA__ABD16585
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuacaaucauugagagaaacaucaccgaaauuguguaucugacaaauaccacgaucgagaaggaaauuugucccaaacucgucgaguaccggaacugguccaagccucagugcaaaaucaccggguucgcccccuuuucuaaggacaauagcauucgccuguccgcgggaggcgauaucugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucauuuacgaugggcggcuugucgacucuaucggauccuggagcaagaauauucugcgcacccaggagucugaaugcguguguaucaacggcacaugcacgguggucaugaccgauggguccgcuagcgagagagccgacacaaaaauucucuuuaucgaggaaggaaagaucguucacauuagcccccugucuggcagcgcgcaacauguggaggaaugcuccuguuauccucgguaccccggggugcgcugcgucuguagagauaauuggaagggaagcaaccggccgaucguggacauuaacguuaaagauuacucuaucguguccagcuaugucugcucuggccuugugggcgacaccccucgcaagaaugacagaagcuccucuagcuacugucggaaccccaauaacgagaaagggucccacggaguuaagggcugggccuucgaugacgggaaugauguguggaugggacgcacaauuggcgaggaacugagaagcggguaugagaccuuuaaagucaucggaggcuggucuacgccuaacuccaagcuccagaucaauagacaggugauugucgacagcggcaaccggucuggguacuccggaaucuucagcguggaaggcaaauccugcauuaaucgcuguuuuuauguugagcugauccgggggagagaacaggagacacgcgugugguggaccucuaacagcauugucguguucugcggaaccuccggcacauacgggaccggcucuuggcccgauggagcugacaucaaucugaugcccauuuga

SEQ ID NO: 197838 - RNA, 1410 nt, Artificial Sequence
  derived and/or modified sequence opt5 from neuraminidase__InfluenzaA__ABD16721
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacaaagaucguguaucugaccaauacaaccauugaaaaagagaucugucccaagcucgucgaauaccggaacugguccaaaccucagugcaagauuacgggguucgcccccuuuucuaaggacaauagcauccgccuguccgcgggaggcgauaucugggugaccagagagccuuauguuucuugugacccggggaaaugcuaccaauucgcucuuggacagggcacaacccugaacaauaagcauagcaacgauacaauucacgaccggacccccuaucgcacgcuccugaugaaugagcugggggugccuuuucaucucggaacaaaacaggucuguaucgccugguccuccucuuccugccacgauggcaaggccuggcugcauguguguguuaccggccacgacaaaaacgcuacagccagcuucauuuacgaugggagacuuguggacucuaucggauccuggagcaagaauauucugcggacccaggaaucugagugcgucuguaucaacgggaccugcacaguggugaugacggauggcuccgcuagcgaacgcgccgacaccaagauccucuuuauugaggagggaaaaaucguccacauuagcccccugucuggcagcgcgcaacauguugaagagugcuccuguuauccuagauaccccggggugcggugcgugugucgcgauaauuggaagggaagcaacagaccgaucgucgacauuaacgugaaagauuacucuaucguuuccagcuaugugugcucuggccuugucggcgacacaccucggaagaaugaccgcagcuccucuagcuacugucagaaccccaauaacgaaaaagggaaucacggagugaagggcugggccuucgaugacgggaacgauguuuggaugggaagaaccaucggcgaggaacugcgguccggguaugagacauuuaaagugauuggaggcuggagcaccccuaauucuaagcuccagaucaaccgccaggucauuguggacuccaagaauagaagcggcuacucugggaucuucuccgucgagggaaaaagcugcauuaaccgguguuuuuauguggaacugaucagaggccgcgagcaagaaacgcggguuugguggacauccaauucuauuguggucuucugcgggaccagcggaaccuacggcacaggguccuggcccgauggcgcugacaucaaccugaugcccaucuga

SEQ ID NO: 197839 - RNA, 1410 nt, Artificial Sequence; identical to SEQ ID NO: 197508
  derived and/or modified sequence opt5 from neuraminidase__InfluenzaA__ABD16732

SEQ ID NO: 197840 - RNA, 1410 nt, Artificial Sequence
  derived and/or modified sequence opt5 from neuraminidase__InfluenzaA__ABD16743
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggaagggcuccaaucggcccguggucgacaucaacgugaaggacuacagcauugauucuuccuauguuugcagcggccuugugggggacaccccgcgcaacaaugauagaucuagcuccucuuacugucggaacccuaauaacgaaaaaggaacacacggcgucaaggggugggcuuucgacgauggaaaugacguguggaugggccgcaccaucagcgaggauuccagaagcggguaugaaacguuuaaaguuaucggaggcuggucuacacccaacuccaagcugcagaugaauagacaggugauugucgacagcgauaaccggucuggcuacuccgggaucuucagcguggagggaaaauccugcauuaaucgcuguuuuuaugucgagcucauccggggcagagaacaagagacccgcgugugguggaccucuaacagcauuguuguguucugcgggacauccggaaccuacggcacagggucuuggccugacggcgccgauaucaaucugaugcccauuuga

SEQ ID NO: 197841 - RNA, 1410 nt, Artificial Sequence; identical to SEQ ID NO: 197600
  derived and/or modified sequence opt5 from neuraminidase__InfluenzaA__ABD16754

SEQ ID NO: 197842 - RNA, 1410 nt, Artificial Sequence; identical to SEQ ID NO: 197698
  derived and/or modified sequence opt5 from neuraminidase__InfluenzaA__ABD16765

SEQ ID NO: 197843 - RNA, 1410 nt, Artificial Sequence; identical to SEQ ID NO: 197142
  derived and/or modified sequence opt5 from neuraminidase__InfluenzaA__ABD17326

SEQ ID NO: 197844 - RNA, 1410 nt, Artificial Sequence
  derived and/or modified sequence opt5 from neuraminidase__InfluenzaA__ABD38137
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucauugauaucaacgucaaggacuacagcauugugucuuccuauguuugcagcggccuggugggggacacaccccggaaaaaugauucuuucagcuccucucauugucucgacccgaacaaugaggaaggaggccacggggucaagggaugggcuuuugaugacggcaacgauguguggauggggcgcaccaucagcgagaaacugagauccggauacgagacguucaagguuaucgaaggcuggagcaaaccuaauucuaagcugcagacaaaccgccaggugauugucgagcggggcaauagauccggguauagcggaaucuuuucuguggaaggcaaauccugcauuaaccgguguuucuacgucgagcucaucagagggcgcaaggaggaacccgaggugugguggaccagcaauuccauuguuguguuuugcggaaccccuggcacauaugggaccggcucuuggcccgacggagccgauaucaaccugaugcccauuuga

SEQ ID NO: 197845 - RNA, 1413 nt, Artificial Sequence; identical to SEQ ID NO: 197410
  derived and/or modified sequence opt5 from neuraminidase__InfluenzaA__ABD60782

SEQ ID NO: 197846 - RNA, 1410 nt, Artificial Sequence
  derived and/or modified sequence opt5 from neuraminidase__InfluenzaA__ABD60793
augaaccccaaucagaagaucauuaccaucggcagcgugucccugacaauugccacgaucugcuuccucaugcaaauugcuauccuggucaccacaguuacccuucacuuuaaacaguacgagugugacucuccugugaacaaucaggugaugccgugcgaacccaucauuaucgagagaaacauuacagaaaucgucuaucugaccaauacaaccauugagaaggaaaucuguccuaaacucguggaguaccggaacuggagcaagccccagugcaaaauuacgggguucgccccuuuuuccaaggauaauucuauccgccugagcgcgggaggcgacaucuggguuaccagagagcccuauguguccugugauccugggaagugcuaccaauucgcucuuggacagggcacaacccuggacaacaaacauucuaaugauacaauucacgaccggaccccgcaucgcacgcuccugaugaacgaacuggggguccccuuucaccucggaacaagacagguguguaucgccuggagcuccagcucuugccaugauggcaaggccuggcugcacguuugugugaccggcuaugacaaaaaugcuacagccuccuucauuuacgaugggcggcuugucgacagcaucgugucuuggucccagaacauucugcgcacccaagagagcgaaugcguguguaucaauggaaccugcacagucguuaugacggauggcucugcuuccgagagagccgacaccaagauccucuuuauugaggaagggaaaaucgugcacauuagcccucuguccggaucugcgcagcauguggaggaaugcagcuguuauccccgguacccuggcguccgcugcaucuguagagauaacuggaagggguccaaucggcccgugguugacauuaacgugaaggacuacagcaucgauucuuccuaugucugcagcggacuugugggcgacacaccgcgcaacaaugauagaucuagcaacuccuacugucggaauccuaacaaugagaaaggcaaccacgggguuaagggaugggccuucgacgauggcaaugaccuguggauggggcgcaccaucucugaagauagcagauccggauaugagacauuuaaagugauuggcggguggagcacccccaacucuaagcuccagaucaaucggcaggucauuguggacuccgauaacagaagcggauacucuggcaucuucuccgucgagggcaaaagcugcauuaaucgcuguuuuuauguggaacugauccgggggagagagcaagaaacgcgcguuugguggacauccaacucuauuaucguguucugcggaaccagcggcaccuacgggacaggauccuggccugacggcgcugauaucaaucugaugcccauuuga

SEQ ID NO: 197847 - RNA, 1410 nt, Artificial Sequence; identical to SEQ ID NO: 197543
  derived and/or modified sequence opt5 from neuraminidase__InfluenzaA__ABD60804

SEQ ID NO: 197848 - RNA, 1410 nt, Artificial Sequence; identical to SEQ ID NO: 197736
  derived and/or modified sequence opt5 from neuraminidase__InfluenzaA__ABD60815

SEQ ID NO: 197849 - RNA, 1410 nt, Artificial Sequence; identical to SEQ ID NO: 197738
  derived and/or modified sequence opt5 from neuraminidase__InfluenzaA__ABD60826

SEQ ID NO: 197850 - RNA, 1410 nt, Artificial Sequence; identical to SEQ ID NO: 197817
  derived and/or modified sequence opt5 from neuraminidase__InfluenzaA__ABD60837

SEQ ID NO: 197851 - RNA, 1410 nt, Artificial Sequence
  derived and/or modified sequence opt5 from neuraminidase__InfluenzaA__ABD60848
augaaccccaaucagaagaucauuaccaucggcagcgugucccugacaauugccacgaucugcuuccucaugcaagucgcuauucugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggcuuggcuucauguuugugugacaggcgaugacgagaacgccaccgcuuccuucaucuacaaugggagacuggucgauagcauuggaucuugguccaagaaaauccuccggacccaggaaagcgagugcguguguauuaacggcacaugcacgguggucaugaccgacgggucugccuccggaaaggcggauacaaaaauccuguuuauugaggaaggcaagaucguucacaccagccuucuguccgggucugcccaacacguggaggaaugcagcuguuauccucgcuaccccggagugagaugcgucugucgggacaacuggaagggcuccaaucgcccuaucguggauauuaacguuaaagacuacagcaucgugucuuccuaugucugcagcggccucgugggggacacacccagaaagaaugauucuagcuccucuagccauugucuggacccgaacaaugaggaaggaggccacgggguuaaaggaugggcuuucgaugacggcaacgauguguggauggggcggaccauuuccgagaagcugcgcagcggauacgagacguuuaaagucaucgaaggcuggucuaagccuaauuccaaacuccagauuaacagacaggugaucgucgaccggggcaaucgcagcggguauucuggaaucuucuccguggagggcaagagcugcauuaacagauguuuuuacguugaacugauccgggggagaaagcaggagacagaagugcuuuggaccuccaauucuauugucguguucugcggaaccagcggcacauaugggaccggcuccuggcccgauggagccgacaucaaccugaugccuauuuga

SEQ ID NO: 197852 - RNA, 1413 nt, Artificial Sequence
  derived and/or modified sequence opt5 from neuraminidase__InfluenzaA__ABD60881
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucuaacuucuccguuaagcaagauguggucgcgauuaccgacuggagcggcuacuccggaucuuuugugcagcauccggagcucacaggccuggauugcauccgcccuuguuucuggguugaacuugugagagggcugccccgggagaauaccacgaucuggacaagcggauccucuauuagcuucugcggcgucaacuccgacaccgccaacuggagcuggccugauggggcugaacuccccuuuaccaucgacaaguga

SEQ ID NO: 197853 - RNA, 1413 nt, Artificial Sequence
  derived and/or modified sequence opt5 from neuraminidase__InfluenzaA__ABD60892
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagagugauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgcgauaauuggcacgggagcaacagacccuggguuuccuucaaucagaaccuugacuaccagaucggauauauuugcagcggcguguuuggggauaauccucggcccaaagacggagagggcucuuguaacccugugacagucgauggcgccgacggggugaagggauucuccuacaaauauggcaaugggguuuggaucggacgcacgaaguccaacagacugcggaaaggcuuugaaaugauuugggaccccaauggguggaccgauacagacucuaacuucuccgugaagcaagaugucguggcgaucaccgacuggagcggcuacuccggaucuuuuguucagcauccggagcucacaggccuggauugcauucgcccuuguuucuggguggaacuugucagagggcugccccgggagaauaccacgaucuggacaagcggauccucuaucagcuucugcggcgugaacuccgacaccgccaacuggagcuggccugauggggcugaacuccccuuuaccauugacaaguga

SEQ ID NO: 197854 - RNA, 1413 nt, Artificial Sequence; identical to SEQ ID NO: 197852
  derived and/or modified sequence opt5 from neuraminidase__InfluenzaA__ABD60903

SEQ ID NO: 197855 - RNA, 1413 nt, Artificial Sequence; identical to SEQ ID NO: 197439
  derived and/or modified sequence opt5 from neuraminidase__InfluenzaA__ABD60914

SEQ ID NO: 197856 - RNA, 1410 nt, Artificial Sequence
  derived and/or modified sequence opt5 from neuraminidase__InfluenzaA__ABD60925
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacaucaaagacuacagcauugugucuuccuacguuugcagcggccuggugggggacacaccccggaagaaugauucuuucagcuccucucacugucucgacccgaacaaugaagagggaggccauggggucaaaggaugggcuuuugaugacggcaacgauguguggauggggcgcaccaucagcgaaaagcugagauccggauaugagacguucaaaguuaucgagggcuggagcaagccuaauucuaaacugcagauuaaccgccaggugaucgucgaacggggcaauagauccggguacagcggaaucuuuucuguggagggcaaguccugcauuaaccgguguuucuaugucgaacucauuagagggcgcaaggaggaaacagaggugugguggaccagcaauuccaucguuguguuuugcggaaccucuggcacauacgggaccggcagcuggcccgacggagccgauauuaaccugaugccuaucuga

SEQ ID NO: 197857 - RNA, 1413 nt, Artificial Sequence
  derived and/or modified sequence opt5 from neuraminidase__InfluenzaA__ABD60947
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaaucaaagaccgcagccccuauagagcccugaugucuuguccuauuggagaagcccccuccccuuacaacagccgguucgaguccguugcuuggucugccagcgcuugccacgauggcaugggguggcucaccaucggaauuuccggccccgacgauggggccguggcgguccugaaguauaauggaaucauuacagaaaccaucaagagcuggcgcaaacagauccugagaacgcaggagucugagugugugugcguuaacggcuccuguuuuacaauuaugaccgacggcccuagcgaugggccggccucuuaccggaucuucaagauugaaaaaggaaagaucacaaaaagcauugagcucgacgcucccaacucccauuaugaagagugcucuuguuacccugauaccggcaccgugaugugcgucugccgcgacaauuggcacgggagcaacagacccuggguguccuuuaaucaaaaccuggauuaccagaucggauauauuuguagcggcguguucggggacaauccucggcccaaggacggaaagggcucuugcgauccggucaacguugacggcgccgauggggugaaaggauuuuccuaccgcuauggcaaugggguguggaucggaagaacaaagagcaacucuucccggaaaggcuucgagaugaucugggacccuaauggguggacggauaccgacagcaacuuucuugucaagcaggaugugguugcuaugacagacugguccggcuacucuggcagcuucgugcagcaccccgaacugaccggacucgauuguaugcgcccuugcuuuugggucgagcugauuagagggcggcccagagagaaaacaaccaucuggacguccggaucuagcauuuccuucuguggcgugaauagcgacacaguuaacuggucuuggcccgauggggccgaacuuccuuucaccaucgacaaguga

SEQ ID NO: 197858 - RNA, 1410 nt, Artificial Sequence
  derived and/or modified sequence opt5 from neuraminidase__InfluenzaA__ABD61263
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccaugggaugaaaggaugggcuuuugaugacggcaacgauguguggauggggcgcaccauuagcgaaaagcugagauccggauaugagacguucaaaguuaucgagggcuggagcaagccuaauucuaaacuccaggugaaccggcaggucaucguggaacgcggcaauagauccggguacagcggaaucuuuucugucgagggcaaguccugcauuaaccgguguuucuauguggaacugauuagagggcgcaaggaggaaacagagguuugguggaccagcaauuccaucguggucuuuugcggaaccucuggcacauacgggaccggcagcuggcccgacggagccgauauuaaccugaugccuaucuga

SEQ ID NO: 197859 - RNA, 1410 nt, Artificial Sequence; identical to SEQ ID NO: 197169
  derived and/or modified sequence opt5 from neuraminidase__InfluenzaA__ABD61274

SEQ ID NO: 197860 - RNA, 1410 nt, Artificial Sequence
  derived and/or modified sequence opt5 from neuraminidase__InfluenzaA__ABD61285
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggaaacgcuuccggcaaggccgacacaaaaauccucuuuaucgaggaagggaagauuguucacaccagcacacuguccggaucugcgcaacacguggaggaaugcagcugcuauccucgcuaccccggcgugagaugugucugccgggauaacuggaagggguccaaucgcccuaucguggacauuaacaucaaagacuacagcauuguuucuuccuauguguguagcggacuugucggcgauacccccagaaagaaugacucuagcuccucuagccauugccuggauccgaacaaugaggaaggcgggcacggagugaaaggcugggccuucgacgaugggaacgacguuuggaugggacggacgaucuccgagaagcuccgcagcggcuacgagacauuuaaagugaucgaaggguggucuaauccuaacuccaagcugcagauuaauagacaggucaucguggaucggggaaaccgcagcggcuauucuggcauuuucuccgucgaggggaaaagcuguaucaauagaugcuuuuacguggaacugauucggggaagaaaggaggaaaccgagguucucuggaccuccaacucuaucguggucuucuguggcacaagcgggaccuauggaacaggcuccuggcccgacggggcugauauuaaucugaugccuaucuga

SEQ ID NO: 197861 - RNA, 1410 nt, Artificial Sequence; identical to SEQ ID NO: 197615
  derived and/or modified sequence opt5 from neuraminidase__InfluenzaA__ABD61296

SEQ ID NO: 197862 - RNA, 1410 nt, Artificial Sequence; identical to SEQ ID NO: 197736
  derived and/or modified sequence opt5 from neuraminidase__InfluenzaA__ABD61307

SEQ ID NO: 197863 - RNA, 1410 nt, Artificial Sequence; identical to SEQ ID NO: 197754
  derived and/or modified sequence opt5 from neuraminidase__InfluenzaA__ABD61318

SEQ ID NO: 197864 - RNA, 1410 nt, Artificial Sequence; identical to SEQ ID NO: 197085
  derived and/or modified sequence opt5 from neuraminidase__InfluenzaA__ABD61340

SEQ ID NO: 197865 - RNA, 1410 nt, Artificial Sequence; identical to SEQ ID NO: 197085
  derived and/or modified sequence opt5 from neuraminidase__InfluenzaA__ABD61351

SEQ ID NO: 197866 - RNA, 1410 nt, Artificial Sequence
  derived and/or modified sequence opt5 from neuraminidase__InfluenzaA__ABD61362
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaagucuguccuaaacuggccgaguaccggaauuggagcaagccccagugcaacauuaccggguucgcgccuuuuuccaaagacaauucuauccgccuuagcgcuggaggcgauauuugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggcuuggcuucauguuugugugacaggcgaugacgagaacgccaccgcuuccuucaucuacaaugggagacuggucgauagcauuggaucuugguccaagaaaauccuccggacccaggaaagcgagugcguguguauuaacggcacaugcacgguggucaugaccgacgggucugccuccggaaaggcggauacaaaaauccuguuuauugaggaaggcaagaucguucacaccagcucccuuucugggagcgcccaacacguggaggaaugcuccuguuauccucgcuaccccggagugagaugcgucugucgggacaacuggaagggcagcaaucgcccuaucguggauauuaacguuaaagacuacucuaucguguccagcuaugucugcucuggccuggugggggacacacccagaaagaaugauagcuccucuagcucccauugucucgacccgaacaaugaggaaggaggccacgggguuaaaggaugggcuuucgaugacggcaacgauguguggauggggcggaccauuagcgagaagcugcgcucuggauacgagacguuuaaagucaucgaaggcugguccaagccuaauagcaaacugcagauuaacagacaggugaucgucgaccggggcaaucgcucuggguauuccggaaucuucagcguggagggcaaguccugcauuaacagauguuuuuacguugaacucauccgggggagaaagcaggagacagaagugcuguggaccucuaauagcauugucguguucugcggaaccuccggcacauaugggaccggcucuuggcccgauggagccgacaucgaucuuaugccuauuuga

SEQ ID NO: 197867 - RNA, 1410 nt, Artificial Sequence; identical to SEQ ID NO: 197817
  derived and/or modified sequence opt5 from neuraminidase__InfluenzaA__ABD61373

SEQ ID NO: 197868 - RNA, 1410 nt, Artificial Sequence
  derived and/or modified sequence opt5 from neuraminidase__InfluenzaA__ABD61384
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuggugggggacacacccagaaagaaugauagcuccucuagcucccauugucucgacccgaacaaugaggaaggaggccacggggucaaaggaugggcuuucgaugacggcaacgauguguggauggggcggaccauuagcgagaagcugcgcucuggauacgagacguuuaaaguuaucgaaggcugguccaagccuaauagcaaacugcagaucaacagacaggugauugucgaccggggcaaucgcucuggguauuccggaaucuucagcguggaguccaagucuugcauuaacagauguuuuuacgucgaacucauccggggcagaaagcaggagacagaagugcuguggaccagcaauuccauuguuguguucugcgggaccucuggaacauauggcaccgggagcuggcccgauggcgccgacaucaaccuuaugccuauuuga

SEQ ID NO: 197869 - RNA, 1410 nt, Artificial Sequence; identical to SEQ ID NO: 197754
  derived and/or modified sequence opt5 from neuraminidase__InfluenzaA__ABD61395

SEQ ID NO: 197870 - RNA, 1410 nt, Artificial Sequence; identical to SEQ ID NO: 197851
  derived and/or modified sequence opt5 from neuraminidase__InfluenzaA__ABD61406

SEQ ID NO: 197871 - RNA, 1413 nt, Artificial Sequence; identical to SEQ ID NO: 197852
  derived and/or modified sequence opt5 from neuraminidase__InfluenzaA__ABD61521

SEQ ID NO: 197872 - RNA, 1410 nt, Artificial Sequence
  derived and/or modified sequence opt5 from neuraminidase__InfluenzaA__ABD61532
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcccugcgaaccuaucauuaucgagagaaacauuacagaaaucguguaucugaccaauacaaccauugagaaggaaaucugucccaaacucgucgaguaccggaacugguccaagccucagugcaaaauuacgggguucgcccccuuuucuaaggacaauagcauccgccuguccgcgggaggcgauaucugggugaccagagagccuuauguuucuugugacccggggaagugcuaccaauucgcucuuggacagggcacaacccugaacaauaaacauagcaacgauacaauucacgaccggacccccuaucgcacgcuccugaugaaugaacugggggugccuuuucaucucggaacaaagcaggucuguaucgccugguccuccucuuccugccacgauggcaaagccuggcugcauguguguguuaccggccacgacaagaacgcuacagccagcuucauuuacgaugggagacuuguggacucuaucggauccuggagcaaaaauauucugcggacccaggagucugaaugcgucuguaucaacgggaccugcacaguggugaugacggauggcuccgcuagcgagcgcgccgacaccaagauccucuuuauugaggaaggaaagaucguccacauuagcccccugucuggcagcgcgcaacauguugaggaaugcuccuguuauccuagauaccccggggugcggugcgugugucgcgauaauuggaaaggaagcaacagaccgaucgucgacauuaacgugaaggauuacucuaucguuuccagcuaugugugcucuggccuugucggcgacacaccucggaaaaaugaccgcagcuccucuagcuacuguagaaaccccaauaacgagaaggggaaucacggagugaaaggcugggccuucgaugacgggaacgauguuuggaugggacggaccaucggcgaggaacugcgcuccggguaugagacauuuaaggugauuggaggcuggagcaccccuaauucuaaacuccagaucaacagacaggucauuguggacuccgaaaaucggagcggcuacucugggaucuucuccgucgagggaaagagcugcauuaacagauguuuuuauguggaacugauccgcggccgggagcaggaaacgagaguuugguggacauccaauucuauuguggucuucugcgggaccagcggaaccuacggcacaggguccuggcccgauggcgcugacaucucucugaugcccaucuga

SEQ ID NO: 197873 - RNA, 1413 nt, Artificial Sequence
  derived and/or modified sequence opt5 from neuraminidase__InfluenzaA__ABD61543
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucuaacuucuccguuaagcaagauguggucgcgauuaccgacuggagcggcuacuccggaaauuuugugcagcauccggagcucacaggccuggauugcauccgcccuuguuucuggguugaacuugugagagggcugccccgggagaacaccacgaucuggacaucuggaagcuccauuucuuucugcggcgucaacagcgacaccgccaauugguccuggccugauggggcugaacuccccuuuaccaucgacaaguga

SEQ ID NO: 197874 - RNA, 1413 nt, Artificial Sequence; identical to SEQ ID NO: 197852
  derived and/or modified sequence opt5 from neuraminidase__InfluenzaA__ABD63066

SEQ ID NO: 197875 - RNA, 1410 nt, Artificial Sequence; identical to SEQ ID NO: 197277
  derived and/or modified sequence opt5 from neuraminidase__InfluenzaA__ABD77601

SEQ ID NO: 197876 - RNA, 1410 nt, Artificial Sequence
  derived and/or modified sequence opt5 from neuraminidase__InfluenzaA__ABD77612
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauguguccuaaacuggccgaguaccggaauuggcuuaagccccagugcaacauuaccggguucgcgccuuuuagcaaagacaauuccauccgccugucugcuggaggcgauauuugggucacaagagagcccuaugugagcugugacccugauaagugcuaccaauucgcccucgggcagggaaccacacugaacaauggccauuccaacgacaccguucacgaucggacgccguaucgcacacugcucaugaaugaacugggggugcccuuucaucuuggaaccaagcaggucuguaucgccuggucuagcuccagcugccacgacggcaaagccuggcugcauguguguguuacaggcgaugacgagaacgcuaccgcuucuaucauuuacaaugggagacucguggauuccaucggaagcuggucuaagaaaauucugcggacccaggaauccgagugcgucuguaucaacggcacaugcacgguggugaugaccgacgggagcgccucuggaaaggcggauacaaaaauucuuuucaucaaggagggcaagaucguccacaccuccagccuguccgggucugcccaacacguugaagagugcagcuguuauccucgcuaccccggagugagaugcgugugucgggacaacuggaaaggcuccaaucgcccuauugucgauaucaacgugaaggacuacagcauuguuucuuccuaugugugcagcggccucgucggggacacaccccggaaaaaugauucuagcuccucuagccauugucuggacccgaacaaugaagagggaggccacggggugaagggaugggcuuuugaugacggcaacgauguuuggauggggagaaccaucuccgaaaaacugcgcagcggauacgagacguucaaggugauugagggcuggucuaaagccaauuccaagcuccagaucaacagacaggucaucguggaccggggcaaucgcagcggguauucuggaaucuuuuccgucgaaagcaaguccugcauuaacagauguuucuacguggagcugauucggggcagaaaacaggaaacagagguucuuuggaccucuaauagcaucguggucuuuugcgggaccuccggaacauauggcaccgggucuuggccugauggcgcugacauuaaccugaugcccaucuga

SEQ ID NO: 197877 - RNA, 1410 nt, Artificial Sequence
  derived and/or modified sequence opt5 from neuraminidase__InfluenzaA__ABD77634
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauguguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccaucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguucaucaaggagggcaagaucguccacaccagcucccuuucugggagcgcccaacacguugaagagugcuccuguuauccucgcuaccccggagugagaugcgugugucgggacaacuggaaaggcagcaaucgcccuauugucgauaucaacgugaaggacuacucuauuguuuccagcuaugugugcucuggccuggucggggacacaccccggaaaaaugauagcuccucuagcucccauugucucgacccgaacaaugaagagggaggccacggggugaagggaugggcuuuugaugacggcaacgauguuuggauggggagaaccaucagcgaaaaacugcgcucuggauacgagacguucaaggugauugagggcugguccaaagccaauagcaagcugcagaucaacagacaggucaucguggaccggggcaaucgcucuggguauuccggaauuuuuagcgucgaauccaagucuugcaucaacagauguuucuacguggagcucauucggggcagaaaacaggaaacagagguucuguggaccagcaauuccaucguggucuuuugcgggaccucuggaacauauggcaccgggagcuggccugauggcgcugacauuaaccuuaugcccaucuga

SEQ ID NO: 197878 - RNA, 1410 nt, Artificial Sequence; identical to SEQ ID NO: 197877
  derived and/or modified sequence opt5 from neuraminidase__InfluenzaA__ABD77645

SEQ ID NO: 197879 - RNA, 1410 nt, Artificial Sequence; identical to SEQ ID NO: 197877
  derived and/or modified sequence opt5 from neuraminidase__InfluenzaA__ABD77656

SEQ ID NO: 197880 - RNA, 1410 nt, Artificial Sequence; identical to SEQ ID NO: 197150
  derived and/or modified sequence opt5 from neuraminidase__InfluenzaA__ABD77700

SEQ ID NO: 197881 - RNA, 1413 nt, Artificial Sequence; identical to SEQ ID NO: 197852
  derived and/or modified sequence opt5 from neuraminidase__InfluenzaA__ABD77722

SEQ ID NO: 197882 - RNA, 1413 nt, Artificial Sequence; identical to SEQ ID NO: 197852
  derived and/or modified sequence opt5 from neuraminidase__InfluenzaA__ABD77733

SEQ ID NO: 197883 - RNA, 1410 nt, Artificial Sequence
  derived and/or modified sequence opt5 from neuraminidase__InfluenzaA__ABD77744
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaacaucaccggguucgccccuuuuuccaaagacaauucuauucgccuuagcgcgggaggcgauaucugggugacaagagagcccuauguuuccugugacccugauaagugcuaccaauucgcucuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggccuggcuucauguuugugugacaggcgaugacgagaacgcuaccgccuccuucauuuacaaugggagacuggucgauagcaucggaucuugguccaagaaaauucuccggacccaggaaagcgagugcguguguaucaacggcacaugcacgguggucaugaccgacgggucugcuuccggaaaggccgauacaaaaauucuguuuaucgaggaaggcaagaucguucacaccagccuucuguccgggucugcgcaacacguggaggaaugcagcuguuauccucgcuaccccggagugagaugcgucugucgggacaacuggaagggcuccaaucgcccuauuguggauaucaacguuaaagacuacagcauugugucuuccuaugucugcagcggccucgugggggacacacccagaaagaaugauucuagcuccucuagccauugucuggacccgaacaaugaggaaggaggccacgggguuaaaggaugggccuucgaugacggcaacgauguguggauggggcggaccaucuccgagaagcugcgcagcggauacgagacguuuaaagucauugaaggcuggucuaagccuaauuccaaacuccagaucaacagacaggugaucgucgaccggggcaaucgcagcggguauucuggaauuuucuccguggagggcaagagcugcaucaacagauguuuuuacguugaacugauucgggggagaaagcaggagacagaagugcuuuggaccuccaauucuaucgucguguucugcggaaccagcggcacauaugggaccggcuccuggcccgauggagcugacauuaaccugaugccuaucuga

SEQ ID NO: 197884 - RNA, 1410 nt, Artificial Sequence; identical to SEQ ID NO: 197877
  derived and/or modified sequence opt5 from neuraminidase__InfluenzaA__ABD77755

SEQ ID NO: 197885 - RNA, 1410 nt, Artificial Sequence; identical to SEQ ID NO: 197877
  derived and/or modified sequence opt5 from neuraminidase__InfluenzaA__ABD77766

SEQ ID NO: 197886 - RNA, 1410 nt, Artificial Sequence
  derived and/or modified sequence opt5 from neuraminidase__InfluenzaA__ABD77777
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcccugcgaaccuacaaucauugagagaaauaucaccgaaauugucuaucugacaaacaccacgaucgagaaggaaauuugucccaaacucgcugaguaccggaauuggagcaagccucagugcaacaucaccggguucgcccccuuuuccaaagacaauucuauucgccugagcgcgggaggcgauaucugggugacaagagagccuuauguuuccugugacccggauaagugcuaccaauucgcucuugggcagggaaccacacugaacaauggccauucuaacgacaccgugcacgaucggacgcccuaucgcacacuccugaugaaugaacugggggucccuuuucaucucggaaccaaacagguguguaucgccuggagcuccagcucuugccacgacggcaaggccuggcugcauguuugugugacaggcgaugacgagaacgcuaccgccuccuucauuuacaaugggagacuugucgauagcaucggaucuugguccaagaaaauucugcggacccaggaaagcgagugcguguguaucaacggcacaugcacgguggucaugaccgacgggucugcuuccggaaaggccgauacaaaaauucucuuuaucgaggaaggcaagaucguucacaccagccugcuuuccgggucugcgcaacacguggaggaaugcagcuguuauccccgcuacccuggagugagaugcgucugucgggacaacuggaagggcuccaaucgccccauuguggauaucaacguuaaagacuacagcauugugucuuccuaugucugcagcggccuggugggggacacaccgagaaagaaugauucuagcuccucuagccauugucucgacccuaacaaugaggaaggaggccacgggguuaaaggaugggccuucgaugacggcaacgauguguggauggggcggaccaucuccgagaagcugcgcagcggauacgagacguuuaaagucauugaaggcuggucuaagcccaauuccaaacugcagaucaacagacaggugaucgucgaccggggcaaucgcagcggguauucuggaauuuucuccguggagggcaagagcugcaucaacagauguuuuuacguugaacucauucgggggagaaagcaggagacagaagugcuguggaccuccaauucuaucgucguguucugcggaaccagcggcacauaugggaccggcuccuggccugauggagcugacauuaaccuuaugcccaucuga

SEQ ID NO: 197887 - RNA, 1410 nt, Artificial Sequence; identical to SEQ ID NO: 197886
  derived and/or modified sequence opt5 from neuraminidase__InfluenzaA__ABD77788

SEQ ID NO: 197888 - RNA, 1362 nt, Artificial Sequence
  derived and/or modified sequence opt5 from neuraminidase__InfluenzaA__ABD77799
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaauuaucaccuacaacguuguggccggccaagacucuacaagcgugauccugaccggaaauuccucucuuugcccuauuagagggugggcuauccacagcaaagauaacggcauucggaucggcuccaagggggacgucuucgugauucgcgagccguuuaucagcuguucucaucuggaaugcagaacauucuuucucacccagggagcccugcuuaaugauaaacacuccaacggcacaguuaaggaccggagccccuaucgcgcgcugaugucuuguccugugggggaggcucccuccccuuacaauagcagauucgaaucugucgccugguccgccagcgcuugccaugauggaaugggcuggcucaccaucgggauuuccggacccgacaacggcgccguggcuguucugaaauauaauggcaucauuacggagaccaucaagucuuggcggaagaaaauucugcgcacacaggaaagcgaguguaccugcgugaacggguccuguuuuacaaucaugaccgauggaccuagcaauggccucgccucuuacaagaucuucaaaauugagaaggggaaagucacgaaguccaucgaacugaacgcgccgaacagccacuaugaggaaugcucuuguuaccccgacacaggaaaggugaugugcgugugcagagauaauuggcacggcagcaaccggccuugggucuccuuugaccagaaucuugauuaucaaauuggguacaucuguucuggaguuuucggcgacaacccccgcccuaaagauggcaccgggagcugcggacccguguccgccgacggcgcuaauggggugaagggauuuagcuacagauauggcaacggggucuggauuggccggacaaaaucugacuccagccgccauggauucgagaugaucugggauccgaauggcuggaccgagaccgacucuagauuuuccgugcggcaggauguuguggccaugacagaccgcagcggguacuccggaucuuucguccagcacccugaacugacgggccucgauuguaugagacccugcuuuuggguggagcugauucgggggagaccugaagaggaaaccaucuggacaagcggauccaucauuucuuucuguggcguuaacagcgacaccguggauugguccuggcccgacggggcugagcuucccuucacaaucgauaaguga

SEQ ID NO: 197889 - RNA, 1410 nt, Artificial Sequence
  derived and/or modified sequence opt5 from neuraminidase__InfluenzaA__ABD77810
augaaccccaaucagaagaucauuaccaucggcagcauuugcaugguggucgggaucauuucccugauccuccaaaucggaaacauuguuucuaucuggauuagccacuccauccagacaggcaaucagaaccauacggggaccuguaaucagucuauuaucacauacaaaaacagcaccugggugaaucaaacauaugugaacauuuccaauaccaacgucguggccggaaaggacacaaccucuguuauccuggcuggcaauagcucccuuugcccuaucagagggugggccauuuacagcaaagauaacggagugcggaucggcucuaagggcgacgucuucgugauucgcgagccguuuaucuccuguagccaccuggaaugcagaacguucuuucucacccagggggcgcugcuuaaugauaaacauucuaacggaacaguuaaggaccggucccccuaucgcgcucugaugagcuguccugugggcgaggcccccucuccuuacaauuccagauucgaaagcgucgccugguccgcuucugccugccacgaugggaugggauggcucaccauuggcaucagcgggcccgacgauggagcuguggccgugcugaaguauaacggcaucauuacagagaccaucaaauccuggcggaaggaaauucugcgcacgcaggagagcgagugugucugcguuaacggcucuuguuuuacaaucaugaccgacgggccuuccggaggcccggcgagcuacaaaauuuucaagaucgaaaaagggaaggugacaaagucuaucgagcucgaugcccccaauagccauuaugaagagugcuccuguuacccugacaccucuaaagugaugugcgucugcagagauaacuggcacggaagcaaucggcccuggguguccuuugaccagaaccuggauuaccaaaugggcuauauuuguagcgggguuuucggagacaauccucgccccaaggacggcaaaggcucuugcgggccgguguacgucgauggagcuaacggcgugaagggguuuuccuauagauacggaaauggcguuuggaucgggcggaccaaaagcaacucuucccgccagggcuucgagaugauuugggacccuaauggauggacagaaacggauagcaacuuuuucaccaagcaggacguggucgccgugacagauugguccggcuauucugggagcuuuguccagcaccccgagcuuaccggacuggacuguaugagaccuugcuucuggguggaacucauccggggccgccccaaagagaauacaauuuggaccuccgggucuagcaucuccuucuguggaguuaacagcgauacgguggacuggucuuggcccgauggcgcugaacugccuuuuacaauugacaaguga

SEQ ID NO: 197890 - RNA, 1410 nt, Artificial Sequence
  derived and/or modified sequence opt5 from neuraminidase__InfluenzaA__ABD77832
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacggcgggcggcugguggacagcaucggaucuugguccaaaaagauucuccgcacccaggaaagcgagugcgucuguaucaacggcacaugcacgguggugaugaccgaugggucugccuccggacgcgcggacacaaaaauucuguuuaucgaggaaggcaagaucguccacauuagcccucuuuccgggucugcccaacauguugaggaaugcagcuguuauccccgguacuccggagugcgcugcguguguagagauaauuggaagggcagcaaccggccuaucgucgacauuaacgugaaagauuacucuaucguuuccagcuaugugugcucuggccuggucggggacacccccagaaagaaugacagcuccucuagcucccacugucucaacccgaauaacgaggaaggaggccauggggugaaaggaugggcuuucgaugacggcaaugauguuuggauggggagaacaauuagcgagaaguuucggucuggauacgagaccuucaaagugaucggcggcugguccaagccuaacagcaaacugcagaucaaucgccaggucauuguggacagagggaaccggucuggauauuccggcaucuuuagcgucgaagggaaguccugcauuaauagauguuucuacguggagcugauccgcggacggaagcaggaaacggagguuugguggacaucuaacagcauuguggucuuuugcggcaccuccgggaccuauggcacaggaucuuggcccgauggcgccgacaucaaucucaugccuauuuga

SEQ ID NO: 197891 - RNA, 1410 nt, Artificial Sequence
  derived and/or modified sequence opt5 from neuraminidase__InfluenzaA__ABD77876
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacuccggggugcgcugcguguguagagacaauuggaagggaagcaaccggccuaucgucgauauuaacgugaaagacuacucuaucguuuccagcuaugugugcucuggccuggucggcgacacaccccgcaagaaugauagcuccucuagcucccacugucucaacccgaauaacgaggaagggggacauggcgugaaagggugggcuuucgacgauggaaaugacguuuggaugggcagaaccauuagcgagaagcugcggucuggguacgagaccuuuaaagugaucgaaggaugguccaagccuaacagcaaacugcagaucaaucgccaggucauuguggauagaggcaaccggucuggcuauuccgggaucuucagcgucgagggaaaguccugcauuaauagauguuuuuacguggaacucauccgcggccggaagcaggagacggaaguuugguggacaucuaacagcauuguggucuucugcgggaccuccggaaccuauggcacagggucuuggcccgacggcgccgauaucaaucugaugccuauuuga

SEQ ID NO: 197892 - RNA, 1410 nt, Artificial Sequence; identical to SEQ ID NO: 197150
  derived and/or modified sequence opt5 from neuraminidase__InfluenzaA__ABD77887

SEQ ID NO: 197893 - RNA, 1410 nt, Artificial Sequence
  derived and/or modified sequence opt5 from neuraminidase__InfluenzaA__ABD77898
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucauucacaucagcccucuuuccggcucugcccaacaugucgaggaaugcagcuguuauccccgguacccugggguucgcugcguguguagagacaauuggaagggauccaaccggcccauuguggauaucaacgucaaagacuacagcauugugucuuccuauguuugcagcggccuggugggcgacaccccgcgcaagaaugauucuagcuccucuagccacugucucaacccuaauaacgaggaagggggacauggcgucaaagggugggcuuucgacgauggauccgacguguggaugggcagaacaaucagcgagaagcugcggucuggguacgagaccuuuaaaguuaucgaaggaugguccaagcccaauagcaaacugcagauuaaccgccaggugaucgucgauagaggcaaucggucuggcuauuccgggauuuucagcguggagggaaaguccugcaucaacagauguuuuuacgucgaacucauucgcggccggaagcaggagacggaagugugguggacaucuaauagcaucguuguguucugcgggaccuccggaaccuauggcacagggucuuggccugacggcgccgauauuaaccugaugcccaucuga

SEQ ID NO: 197894 - RNA, 1410 nt, Artificial Sequence
  derived and/or modified sequence opt5 from neuraminidase__InfluenzaA__ABD77909
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuuuccggcucugcccaacauguugaggaaugcagcuguuauccccgguacccuggggugcgcugcguguguagagacaauuggaagggauccaaccggcccaucgucgauauuaacgugaaagacuacagcaucguuucuuccuaugugugcagcggccuggucggcgacaccccgcgcaagaaugauucuagcuccucuagccacugucucaacccuaauaacgaggaagggggacauggcgugaaagggugggcuuucgacgauggaaaugacguuuggaugggcagaacaauuuccgagaagcugcggagcggguacgagaccuuuaaagugaucgaaggauggucuaagcccaacuccaaacugcagaucaaucgccaggucauuguggauagaggcaacagcucuggcuauuccgggaucuucagcgucgagggaaaguccugcauuaaucgguguuuuuacguggaacucaucagaggccgcaagcaggagacggaaguuugguggacaucuaacagcauuguggucuucugcgggaccuccggaaccuauggcacagggucuuggccugacggcgccgauaucaaucugaugcccauuuga

SEQ ID NO: 197895 - RNA, 1413 nt, Artificial Sequence; identical to SEQ ID NO: 197852
  derived and/or modified sequence opt5 from neuraminidase__InfluenzaA__ABD77920

SEQ ID NO: 197896 - RNA, 1413 nt, Artificial Sequence; identical to SEQ ID NO: 197852
  derived and/or modified sequence opt5 from neuraminidase__InfluenzaA__ABD77931

SEQ ID NO: 197897 - RNA, 1413 nt, Artificial Sequence; identical to SEQ ID NO: 197852
  derived and/or modified sequence opt5 from neuraminidase__InfluenzaA__ABD77942

SEQ ID NO: 197898 - RNA, 1413 nt, Artificial Sequence
  derived and/or modified sequence opt5 from neuraminidase__InfluenzaA__ABD77953
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucuaacuucuccguuaagcaagauguggucgcgauuaccgacuggagcggcuacuccggaucuuuugugcagcauccggagcucacaggccuggauugcauccgcccuuguuuccuuguugaacuggugagagggcucccccgggagaauaccacgaucuggacaagcggauccucuauuagcuucugcggcgucaacuccgacaccgccaacuggagcuggccugauggggcugaacugcccuuuaccaucgacaaguga

SEQ ID NO: 197899 - RNA, 1413 nt, Artificial Sequence
  derived and/or modified sequence opt5 from neuraminidase__InfluenzaA__ABD77964
augaaccccaaucagaagaucauuaccaucggcagcauuuccaucgccauugggaucaucucucugaugcuccaaauuggaaacaucauuagcaucugggcuucccacucuauucagacaagaagccagaaucauacgggcaucugcaaccagcggauuaucaccuacgagaauagcacaugggugaaccacaccuaugucaauaucaacaauacaaacguuguggccgggaaagacaagaccucugugacacuggcgggaaauagcucccuuuguagcauuucuggcugggcuaucuacaccaaagauaacuccauucgcaucgggagcaagggagacgucuucgugauuagagaaccuuuuaucucuugcucccaucuggagugucggacguucuuucucacccaaggcgcccugcuuaaugauaaacacagcaacggcacaguuaaggaccgcucuccguauagagcccugauguccugcccccucggggaagcuccuagccccuacaauuccaaguucgagucuguggccuggagcgcuuccgccugucaugauggaaugggcuggcugaccaucgggauuagcggaccugacaacggcgcggucgccgugcugaaauauaacgggaucauuacagaaaccaucaagucuuggaaaaagcggauucuccgcacgcaggaguccgagugcguuugugugaauggaagcugcuuuacaaucaugaccgauggccccucuaacggcgcugccagcuacaaaaucuucaagauugaaaaggggaaagucacaaaguccaucgagcugaaugcuccuaacuuucacuaugaagaguguucuugcuacccggacaccggaaccgugaugugugugugcagagauaauuggcacggcagcaaccggcccugggucuccuucaaucagaaccuugacuaccagauuggguauaucugcagcggaguuuuuggcgauaauccucgccccaaagacggggagggaucuuguaacccugugacaguggauggcgccgacggcgucaagggguucuccuacaaauauggaaauggcguguggauugggagaacgaaguccaaccggcugcgcaaaggauuugaaaugaucugggaccccaauggcuggaccgauacagacucuaacuucuccguuaagcaagauguggucgcgauuaccgacuggagcggguacuccggcucuuuugugcagcauccggagcucacaggacuggauugcaucagaccuuguuucuggguugaacuugugcggggccugccccgcgagaauaccacgaucuggacaagcggguccucuauuagcuucugcggagucaacuccgacaccgccaacuggagcuggccugauggcgcugaacuccccuuuaccaucgacaaguga

SEQ ID NO: 197900 - RNA, 1413 nt, Artificial Sequence; identical to SEQ ID NO: 197852
  derived and/or modified sequence opt5 from neuraminidase__InfluenzaA__ABD77975

SEQ ID NO: 197901 - RNA, 1413 nt, Artificial Sequence; identical to SEQ ID NO: 197852
  derived and/or modified sequence opt5 from neuraminidase__InfluenzaA__ABD77986

SEQ ID NO: 197902 - RNA, 1413 nt, Artificial Sequence
  derived and/or modified sequence opt5 from neuraminidase__InfluenzaA__ABD77997
augaaccccaaucagaagaucauuaccaucggcagcauuuccaucgccauugggauccugucucucaugcugcaaaucggaaacauuaucagcauuugggcuucccacucuauccagacaggcagccagaaucauacggggauuugcaaccagagaaucauuaccuacgagaauagcacaugggugaaccacaccuaugucaauaucaacaauacaaacguuguggccggaaaagacaagaccucugugacacuugcgggcaauagcucccuguguagcaucucugggugggcuauuuacaccaaagauaacuccauccggauuggaagcaagggcgacgucuucgugauccgcgaaccuuuuauuucuugcucccaucucgaguguagaacguucuuucugacccaaggcgcccuucugaaugauaaacacagcaacgggacaguuaaggaccggucuccguaucgcgcccucauguccugcccccugggagaagcuccuagccccuacaauuccaaguucgagucuguggccuggagcgcuuccgccugucaugauggcaugggguggcugaccaucggaaucagcggcccugacaacggggcggucgccgugcucaaauauaacggaauuaucacagaaaccauuaagucuuggaaaaagagaauccugcggacgcaggaguccgagugcguuugugugaauggcagcugcuuuacaauuaugaccgauggccccucuaacggggcugccagcuacaaaaucuucaagaucgaaaagggaaaagucacaaaguccauugagcuuaaugcuccuaacuuucacuaugaagaguguucuugcuacccggacaccggcaccgugaugugugugugccgcgauaauuggcacgggagcaacagacccugggucuccuucaaucagaaccuggacuaccagaucggauauauuugcagcggcguuuuuggggauaauccucggcccaaagacggagagggcucuuguaacccugugacaguggauggcgccgacggggucaagggauucuccuacaaauauggcaaugggguguggaucggacgcacgaaguccaacagacuccggaaaggcuuugaaaugauuugggaccccaauggguggaccgauacagacaacaauuucucuguuaagcaagauguggucgcgaucaccgacugguccggcuacagcggauccuuugugcagcauccggagcugacaggccuugauugcauucgcccuuguuucuggguugaacuggugagagggcucccccgggagaacaccacgaucuggacaucuggaagcuccaucucuuucugcggcgucaacagcgacaccgccaauugguccuggccugauggggcugaacugcccuuuaccauugacaaguga

SEQ ID NO: 197903 - RNA, 1413 nt, Artificial Sequence; identical to SEQ ID NO: 197852
  derived and/or modified sequence opt5 from neuraminidase__InfluenzaA__ABD78008

SEQ ID NO: 197904 - RNA, 1413 nt, Artificial Sequence; identical to SEQ ID NO: 197852
  derived and/or modified sequence opt5 from neuraminidase__InfluenzaA__ABD78019

SEQ ID NO: 197905 - RNA, 1413 nt, Artificial Sequence
  derived and/or modified sequence opt5 from neuraminidase__InfluenzaA__ABD78030
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaaccggacaguuaaggaccgcucuccguauagagcccugauguccugcccccucggggaagcuccuagccccuacaauuccaaguucgagucuguggccuggagcgcuuccgccugucaugauggaaugggcuggcugaccaucgggauuagcggaccugacaacggcgcggucgccgugcugaaauauaacgggaucauuacagaaaccaucaagucuuggaaaaagcggauucuccgcacgcaggaguccgagugcguuugugugaauggaagcugcuuuacaaucaugaccgauggccccaacaauggcgcugccucuuacaaaaucuucaagauugaaaaggggaaagucacaaagagcaucgagcugaacgcuccuaauuuucacuaugaagaguguuccugcuacccggacaccggaaccgugaugugugugugcagagauaacuggcacggcucuaaucggcccugggucagcuucaaccagaaucuugacuaccagauuggguauaucugcuccggaguuuuuggcgauaacccucgccccaaagacggggagggaagcuguaauccugugacaguggauggcgccgacggcgucaagggguucucuuacaaauauggaaacggcguguggauugggagaacgaaguccaaucggcugcgcaaaggauuugaaaugaucugggaccccaacggcuggaccgauacagacagcaauuucucuguuaagcaagauguggucgcgauuaccgacugguccggguacagcggcuccuuugugcagcauccggagcucacaggacuggauugcaucagaccuuguuucuggguugaacuugugcggggccugccccgcgagaacaccacgaucuggacaucugggagcuccauuucuuucugcggagucaacagcgacaccgccaauugguccuggccugauggcgcugaacuccccuuuaccaucgacaaguga

SEQ ID NO: 197906 - RNA, 1413 nt, Artificial Sequence
  derived and/or modified sequence opt5 from neuraminidase__InfluenzaA__ABD78041
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccagcaccgugaugugugugugccgcgauaauuggcacggcuccaacagacccugggucagcuucaaucagaaccuugacuaccagauuggguauaucugcucuggaguuuuuggcgauaauccucggcccaaagacggggagggauccuguaacccugugacaguggauggcgccgacggcgucaagggguucagcuacaaauauggaaauggcguguggauugggcgcacgaagucuaacagacugcggaaaggauuugaaaugaucugggaccccaauggcuggaccgauacagacuccaacuucagcguuaagcaagauguggucgcgauuaccgacugguccggguacucuggcagcuuugugcagcauccggagcucacaggacuggauugcauccgcccuuguuucuggguugaacuugugagaggccugccccgggagaauaccacgaucuggacauccgggucuagcauuuccuucugcggagucaacagcgacaccgccaacuggucuuggccugauggcgcugaacuccccuuuaccaucgacaaguga

SEQ ID NO: 197907 - RNA, 1410 nt, Artificial Sequence; identical to SEQ ID NO: 197886
  derived and/or modified sequence opt5 from neuraminidase__InfluenzaA__ABD78052

SEQ ID NO: 197908 - RNA, 1413 nt, Artificial Sequence; identical to SEQ ID NO: 197420
  derived and/or modified sequence opt5 from neuraminidase__InfluenzaA__ABD78063

SEQ ID NO: 197909 - RNA, 1413 nt, Artificial Sequence; identical to SEQ ID NO: 197420
  derived and/or modified sequence opt5 from neuraminidase__InfluenzaA__ABD78074

SEQ ID NO: 197910 - RNA, 1413 nt, Artificial Sequence; identical to SEQ ID NO: 197420
  derived and/or modified sequence opt5 from neuraminidase__InfluenzaA__ABD78085

SEQ ID NO: 197911 - RNA, 1413 nt, Artificial Sequence; identical to SEQ ID NO: 197420
  derived and/or modified sequence opt5 from neuraminidase__InfluenzaA__ABD78096

SEQ ID NO: 197912 - RNA, 1410 nt, Artificial Sequence
  derived and/or modified sequence opt5 from neuraminidase__InfluenzaA__ABD78118
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauguguccuaaacuggccgaguaccggaauuggagcaagccccagugcaaaauuaccggguucgcgccuuuuuccaaggacaacucuauccgccuuagcgcuggaggcgauauuugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucaucuacgacggccggcugguggauagcauugggucuugguccaaaaagauccuccgcacccaggaaagcgagugcgucuguauuaacggaacaugcacgguggugaugaccgacggcucugccuccgggagagcggauacaaaaauccuguuuauugaggaaggaaagaucguccacaucagcccucuuuccggcucugcccaacauguugaggaaugcagcuguuauccccgguacuccggggugcgcugcguguguagagacaauuggaagggaagcaaccggccuauugucgauaucaacgugaaagacuacucuauuguuuccagcuaugugugcucuggccuggucggcgacacaccccgcaagaaugauagcuccucuagcucccacugucucaacccgaauaacgaggaagggggacauggcgugaaagggugggcuuucgacgauggaaaugacguuuggaugggcagaaccaucagcgagaaguuucggucuggguacgagaccuucaaagugauuggaggcugguccaagccuaacagcaaacugcagaucaaucgccaggucaucguggauagaggcaaccggucuggguauuccggaauuuuuagcgucgaaggcaaguccugcaucaauagauguuucuacguggagcugauucgcgggcggaagcaggaaacggagguuugguggacaucuaacagcaucguggucuuuugcggaaccuccggcaccuaugggacaggcucuuggcccgacggagccgauauuaaucucaugccuaucuga

SEQ ID NO: 197913 - RNA, 1410 nt, Artificial Sequence; identical to SEQ ID NO: 197912
  derived and/or modified sequence opt5 from neuraminidase__InfluenzaA__ABD78129

SEQ ID NO: 197914 - RNA, 1410 nt, Artificial Sequence; identical to SEQ ID NO: 197142
  derived and/or modified sequence opt5 from neuraminidase__InfluenzaA__ABD79035

SEQ ID NO: 197915 - RNA, 1353 nt, Artificial Sequence
  derived and/or modified sequence opt5 from neuraminidase__InfluenzaA__ABD79115
augaaccccaaucagaagaucauuaccaucggcagcauuugcaugguggucgggaucauuucccugaucuuccaaaucggaaacauuguuucuaucuggauuagccacuccaucacaggcacguguaauagaucuauuuacgugaacaucagcaauaccaacguggucgccgggaaagacacaaccuccgugauucucgcuggaaauucuagccugugcccuauccggggcugggccaucuauuccaaggauaacgggguucgcauuggaagcaaaggcgacguguuugucaucagagagccguucauuucuuguucccaucuugaaugccggacauuuuuccugacccagggcgcgcuccugaaugauaagcacagcaacgggacagugaaagaccgcucucccuacagaacccuuauguccuguccuguuggagaggcucccagcccuuauaauucucgguuugaauccguggccuggagcgccuccgcuugccaugauggcaugggguggcugacgaucggaauuucuggccccgacgauggggccgucgcugugcucaaguacaacggaaucaucaccggcacaauuaagagcuggcgcaaagagauccugagaacccaggaauccgagugugugugcgucaauggcagcuguuucacaauuaugaccgacgggccuucuggaggcccggccuccuauaagaucuuuaaaauugagaaggggaaaguuacgaagucuaucgaacuggaugcgcccaacucucacuacgaggaaugcagcuguuauccugacacauccaaggugaugugcgugugccgggauaauuggcauggaucuaaccgccccugggucagcuucgaccagaaccucgauuaccaaaugggcuacaucuguuccgggguguuuggagacaauccuagacccaaagacggcaagggcagcugcgggccgguuuauguggauggagccaacggcgucaaaggguucucuuaccgguauggaaauggcguguggauugggcgcaccaaguccagcagcuccagacagggcuuugagaugaucugggacccuaacggauggacagagaccgauagcaauuucuuuaugaaacaggacguuguggcugucaccgauugguccggcuacucugggagcuucgugcagcaccccgaacugacaggacuugacuguaugcggccuugcuucugggucgagcugauucgcggcagacccaaggaaaacacgaucuggaccuccgggucuagcauuuccuuuuguggagugaauagcgauacaguugacuggucuuggcccgauggcgccgagcucccuuucaccaucgacaaauga

SEQ ID NO: 197916 - RNA, 1410 nt, Artificial Sequence
  derived and/or modified sequence opt5 from neuraminidase__InfluenzaA__ABD79126
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccgggagagccgauacaaagauccuguuuaucgaggaaggcaaaauuguccacaucagcccucuuuccgggucugcgcaacauguugaggaauguagcugcuacccccgguauccuggagugcgcugugugugcagagacaacuggaagggcuccaaucggcccauugucgauaucaacgugaaggacuacagcauuguuucuuccuacguguguagcggccuggucggggauaccccgcgcaaaaaugacucuagcuccucuagcuauugccucgacccuaacaaugaggaaggaggccacggggugaagggaugggccuucgaugacggcaacgauguuuggauggggagaacaaucuccgagaaacugcggagcggauacgagaccuuuaaggugaucggcggcuggucuaaacccaauuccaagcugcagauuaaccgccaggucaucguggacaaagggaauagaagcggauauucuggcauuuucuccgucgaaggaaagagcuguaucaaccggugcuuuuacguggagcucauuagaggacgcaagcaggaaacggagguuugguggacauccaauucuaucguggucuucuguggcaccagcgggaccuauggcacaggauccuggccugauggcgcugacauuaaccugaugcccaucuga

SEQ ID NO: 197917 - RNA, 1410 nt, Artificial Sequence; identical to SEQ ID NO: 197916
  derived and/or modified sequence opt5 from neuraminidase__InfluenzaA__ABD79137

SEQ ID NO: 197918 - RNA, 1410 nt, Artificial Sequence; identical to SEQ ID NO: 197916
  derived and/or modified sequence opt5 from neuraminidase__InfluenzaA__ABD79148

SEQ ID NO: 197919 - RNA, 1410 nt, Artificial Sequence; identical to SEQ ID NO: 197916
  derived and/or modified sequence opt5 from neuraminidase__InfluenzaA__ABD79159

SEQ ID NO: 197920 - RNA, 1410 nt, Artificial Sequence
  derived and/or modified sequence opt5 from neuraminidase__InfluenzaA__ABD79170
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaauaacaccguucacgaucgcacgccguacagaacacugcugaugaaugaacucggggugcccuuucaucugggaaccaaacaggucugcauugccuggagcuccagcucuugucacgacggcaaggccuggcuucaugugugcguuacaggccacaacgagaaugcuaccgccuccuucaucuaugaugggcggcugguggacagcauuggaucuugguccaaaaacauccuccgcacccaggaaagcgagugugucugcauuaacggcacaugcacgguggugaugaccgaugggucugcuuccgggagagccgacacaaagauccuguuuaucaaagagggcaagauuguccacguuagcccucuuuccgggucugcgcaacauguggaagaguguagcugcuacccccgguauccuggagugcgcugugucugcagagauaauuggaagggcuccaaccggcccaucguggacauuaauguuaaagauuacagcaucgugucuuccuacgucuguagcggccuggugggggacaccccgcgcaagaacgauucuagcuccucuagcuauugccucgacccuaauaacgaagagggaggccacgggguuaaaggaugggccuucgacgauggcaaugacguguggauggggagaacaauuuccgaaaagcugcggagcggauacgagaccuuuaaagucaucggcggcuggucuaagcccaacuccaaacugcagaucaaucgccaggugauugucgauaaggggaacagaagcggauauucuggcaucuucuccguggagggaaagagcuguauuaaucggugcuuuuacguugaacucaucagaggacgcaaacaggagacggaagugugguggacauccaacucuauugucguguucuguggcaccagcgggaccuauggcacaggauccuggccugacggcgcugauaucaaucugaugcccauuuga

SEQ ID NO: 197921 - RNA, 1410 nt, Artificial Sequence; identical to SEQ ID NO: 197916
  derived and/or modified sequence opt5 from neuraminidase__InfluenzaA__ABD79181

SEQ ID NO: 197922 - RNA, 1410 nt, Artificial Sequence; identical to SEQ ID NO: 197916
  derived and/or modified sequence opt5 from neuraminidase__InfluenzaA__ABD79192

SEQ ID NO: 197923 - RNA, 1410 nt, Artificial Sequence
  derived and/or modified sequence opt5 from neuraminidase__InfluenzaA__ABD79203
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaaaugcccuaagcuggcugaguaucggaauuggagcaaaccccaguguaagaucaccggguucgccccuuuuuccaaggacaacucuauucgccuuagcgcgggaggcgauaucugggucacaagagagcccuacguguccugcgacccugggaaauguuaucaauucgcucugggacagggcaccacacucaauaaccggcauucuaaugauaccguucacgaccgcacgccguacagaacacugcugaugaacgaacucggggugcccuuucaucugggaaccaagcaggucugcaucgccuggagcuccagcucuugucacgauggcaaagccuggcuucaugugugcguuacaggccacaaugagaacgcuaccgccuccuucauuuaugacgggcggcugguggauagcaucggaucuugguccaagaauauucuccgcacccaggaaagcgagugugucugcaucaacggcacaugcacgguggugaugaccgacgggucugcuuccgggagagccgauacaaaaauucuguuuaucgaggaaggcaagaucguccacauuagcccucuuuccgggucugcgcaacauguugaggaauguagcugcuacccccgguauccuggagugcgcugugugugcagagacaacuggaagggcuccaaucggcccaucgucgauauuaacaugaaagacuacagcaucgugucuuccuacguuuguagcggccuggugggggauaccccgcgcaagaaugacucuagcuccucuagcuauugccucgacccuaacaaugaggaaggaggccacggggucaaaggaugggccuucgaugacggcaacgauguguggauggggagaacaauuuccgagaagcugcggagcggauacgagaccuuuaaaguuaucggcggcuggucuaagcccaauuccaaacugcagaucaaccgccaggugauugucgacaaggggaauagaagcggauauucuggcaucuucuccguggaaggaaagagcuguauuaaccggugcuuuuacgucgagcucaucagaggacgcaaacaggaaacggaggugugguggacauccaauucuauuguuguguucuguggcaccagcgggaccuauggcacaggauccuggccugauggcgcugacaucaaccugaugcccauuuga

SEQ ID NO: 197924 - RNA, 1410 nt, Artificial Sequence; identical to SEQ ID NO: 197916
  derived and/or modified sequence opt5 from neuraminidase__InfluenzaA__ABD79214

SEQ ID NO: 197925 - RNA, 1410 nt, Artificial Sequence
  derived and/or modified sequence opt5 from neuraminidase__InfluenzaA__ABD79236
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaauaacaccgcccacgaucgcacgccguacagaacacugcugaugaaugaacucgggguucccuuucaucugggaaccaaacaggugugcauugccuggagcuccagcucuugucacgacggcaaggcuuggcuucaugucugcgugacaggccacaacgagaaugccaccgcuuccuucaucuaugaugggcggcugguugacagcauuggaucuugguccaaaaacauccuccgcacccaggaaagcgagugugugugcauuaacggcacaugcacggucgugaugaccgaugggucugccuccgggagagcggacacaaagauccuguuuaucaaagagggcaagauugugcacaucagcccucuuuccgggucugcccaacaugucgaagaguguagcugcuacccccgguauccuggaguucgcugugugugcagagauaauuggaagggcuccaaccggcccauuguggacaucaaugucaaagauuacagcauugugucuuccuacguuuguagcggccuggugggggacaccccgcgcaagaacgauucuagcuccucuagcuauugccucgacccuaauaacgaagagggaggccacggggucaaaggaugggcuuucgacgauggcaaugacguguggauggggagaacaaucuccgaaaagcugcggagcggauacgagaccuuuaaaguuaucggcggcuggucuaagcccaacuccaaacugcagauuaaucgccaggugaucgucgauaaggggaacagaagcggauauucuggcauuuucuccguggagggaaagagcuguaucaaucggugcuuuuacgucgaacucauuagaggacgcaaacaggagacggaagugugguggacauccaacucuaucguuguguucuguggcaccagcgggaccuauggcacaggauccuggccugacggcgccgauauuaaucugaugcccaucuga

SEQ ID NO: 197926 - RNA, 1410 nt, Artificial Sequence
  derived and/or modified sequence opt5 from neuraminidase__InfluenzaA__ABD79247
augaaccccaaucagaagaucauuaccaucggcagcgugucccugacaauuacgaccaucugcuuccucaugcaaauugccauccuggucaucacaguuacccuucacuuuaaacagugugagugcaacccuccgcccaauaaccaggugaugcugugugaaccuacaauuaucgagagaaauauuaccgaaaucguguaccucacaaacaccacgauugagaaggaaaucugccccaaacuggcugaguaucggaauuggucuaagccucaguguaaaauuaccggguucgcccccuuuagcaaggacaacuccauccgccuuucugcgggaggcgauaucugggucacaagagagccuuacgugagcugcgacccggggaaguguuaucaauucgcucugggacagggcaccacacucaauaaccggcauuccaaugauaccguucacgaccgcacgcccuacagaacacugcugaugaacgaacucggggugccuuuucaucugggaaccaaacaggucugcauugccuggucuagcuccagcugucacgauggcaaggccuggcuucaugugugcguuacaggccacaaugagaacgcuaccgccucuuucaucuaugacgggcggcugguggauuccauuggaagcuggucuaaaaauauccuccgcacccaggaauccgagugugucugcauuaacggcacaugcacgguggugaugaccgacgggagcgcuucuggcagagccgauacaaagauccuguuuaucgaggaaggaaaaauuguccacaucagcccccuuuccggguccgcgcaacauguugaggaauguucuugcuacccucgguaucccggagugcgcugugugugcagagacaacuggaagggcagcaaucggccgauugucgauaucaacgugaaggacuacuccauuguuagcucuuacguguguuccggccuggucggggauaccccucgcaaaaaugacagcucuagcuccucuuauugccucgaccccaacaaugaggaaggaggccacggggugaagggaugggccuucgaugacggcaacgauguuuggauggggagaacaaucagcgagaaacugcgguccggauacgagaccuuuaaggugaugggcggcuggagcaaaccuaauucuaagcugcagaucaaccgccaggucauuguggacagagggaaucgguccggauauagcggcaucuucucugucgaagggaaauccuguauuaacagaugcuuuuacguggagcucauccgcggacggaagcaggaaacggagguuugguggacaagcaauuccauuguggucuucuguggcaccucugggaccuauggcacaggaagcuggcccgauggcgcugacaucaaccugaugcccauuuga

SEQ ID NO: 197927 - RNA, 1410 nt, Artificial Sequence; identical to SEQ ID NO: 197351
  derived and/or modified sequence opt5 from neuraminidase__InfluenzaA__ABD94737

SEQ ID NO: 197928 - RNA, 1410 nt, Artificial Sequence; identical to SEQ ID NO: 197736
  derived and/or modified sequence opt5 from neuraminidase__InfluenzaA__ABD94748

SEQ ID NO: 197929 - RNA, 1413 nt, Artificial Sequence; identical to SEQ ID NO: 197852
  derived and/or modified sequence opt5 from neuraminidase__InfluenzaA__ABD94759

SEQ ID NO: 197930 - RNA, 1410 nt, Artificial Sequence; identical to SEQ ID NO: 197085
  derived and/or modified sequence opt5 from neuraminidase__InfluenzaA__ABD94770

SEQ ID NO: 197931 - RNA, 1413 nt, Artificial Sequence; identical to SEQ ID NO: 197420
  derived and/or modified sequence opt5 from neuraminidase__InfluenzaA__ABD94792

SEQ ID NO: 197932 - RNA, 1413 nt, Artificial Sequence; identical to SEQ ID NO: 197420
  derived and/or modified sequence opt5 from neuraminidase__InfluenzaA__ABD94803

SEQ ID NO: 197933 - RNA, 1413 nt, Artificial Sequence; identical to SEQ ID NO: 197420
  derived and/or modified sequence opt5 from neuraminidase__InfluenzaA__ABD94814

SEQ ID NO: 197934 - RNA, 1410 nt, Artificial Sequence; identical to SEQ ID NO: 197597
  derived and/or modified sequence opt5 from neuraminidase__InfluenzaA__ABD94825

SEQ ID NO: 197935 - RNA, 1410 nt, Artificial Sequence
  derived and/or modified sequence opt5 from neuraminidase__InfluenzaA__ABD94847
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccaagaucauugagagaaauaucacagaaauuguguaucucaccaacacaaccaucgagaaagaaauuuguccuaagcuggccgaguaccggaauuggagcaaaccccagugcaagaucacgggguucgcgccuuuuuccaaggacaacucuauucgccuuagcgcuggaggcgauaucugggucaccagagagcccuauguguccugugacccugauaaaugcuaccaauucgcccuggggcagggaacaacccucaauaaccggcauucuaaugacacaguucacgaucgcaccccguauagaacgcugcugaugaacgaacucggcgugcccuuucaucuggggacaaagcaggucuguaucgccuggagcuccagcucuugccacgacggaaaagccuggcuucauguguguguuaccggccacgaugagaaugcuacagcuuccuucauuuacgacggccggcugguggauagcaucgggucuugguccaagaaaauucuccgcacccaggaaagcgagugcgucuguaucaacggaaccugcacaguggugaugacggacggcucugccuccgggagagcggucaccaagauucuguuuaucgaggaaggaaagaucguucacauuagcccucuucugggcuccgcccaacauguggaggaaugcucuuguuauccccgguacccuggggugcgcugcgucuguagagauaauuggaaaggaagcaaccggcccaucguggacauuaacguuaaggauuacuccaucgugagcucuuaugucugcuccggccucgugggcgacacaccgcgcaaaaaugacagcucuagcuccucucacugucugaacccuaauaacgaggaagggggacauggcguuaaggggugggcuuucgaugacggaaaugauguguggaugggcagaaccauuagcgagaaacugcgguccggguacgagacauuuaaggucaucgaaggauggagcaaacccaacucuaagcuccagaucaaucgccaggugauugucgacagaggcaaccgguccggcuauagcgggaucuucucuguggagggaaaguccugcauuaauagauguuuuuacguugaacugauccgcggccggaaacaggagaccgaagugugguggacgagcaacuccauugucguguucugcgggacaucuggaaccuauggcaccgggagcuggccugauggcgccgacaucaaucuuaugcccauuuga

SEQ ID NO: 197936 - RNA, 1410 nt, Artificial Sequence; identical to SEQ ID NO: 197150
  derived and/or modified sequence opt5 from neuraminidase__InfluenzaA__ABD94858

SEQ ID NO: 197937 - RNA, 1410 nt, Artificial Sequence; identical to SEQ ID NO: 197150
  derived and/or modified sequence opt5 from neuraminidase__InfluenzaA__ABD94880

SEQ ID NO: 197938 - RNA, 1410 nt, Artificial Sequence
  derived and/or modified sequence opt5 from neuraminidase__InfluenzaA__ABD94891
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagguccuguuuaucgaggaaggaaaaaucguucacauuagccaacuuuccgggucugcgcagcauguggaggaauguagcugcuacccucgguaucccggagugcgcugugucugcagagacaacuggaagggcuccaaucggccuaucguggauauuaacguuaaggacuacagcaucgugucuuccuacgucuguagcggccuggugggggauacaccccgcaaaaaugacucuagcuccucuagcuauugccucgacccgaacaaugaggaaggaggccacgggguuaagggaugggccuucgaugacggcaacgauguguggauggggagaaccauuuccgagaaacugcggagcggauacgagaccuuuaaggucaucggcggcuggucuaaaccuaauuccaagcugcagaucaaccgccaggugauugucgacagagggaaucggagcggauauucuggcaucuucuccguggaagggaaaagcuguauuaacagaugcuuuuacguugagcucauccgcggacggaagcaagaaacggaggugugguggacauccaauucuauugucguguucuguggcaccagcgggaccuauggcacaggauccuggcccgauggcgcugacaucaaccugaugccuauuuga

SEQ ID NO: 197939 - RNA, 1410 nt, Artificial Sequence; identical to SEQ ID NO: 197916
  derived and/or modified sequence opt5 from neuraminidase__InfluenzaA__ABD94902

SEQ ID NO: 197940 - RNA, 1410 nt, Artificial Sequence
  derived and/or modified sequence opt5 from neuraminidase__InfluenzaA__ABD94924
augaaccccaaucagaagaucauuaccaucggcagcgugucccugacaauugccacgaucugccuccugaugcaaauugcuauccuugucaccacaguuacccugcacuucaaacaguacgaguguaacucuccuccgaauaaccaggugaugcucugcgaacccacaaucauugagagaaauaucaccgaaauuguguaucugacaaacaccacgaucgagaaggaaauuuguccuaaacuugccgaguaccggaauuggagcaagccccagugcaaaaucaccggguuugcgccuuucuccaaggacaacucuauucgccugagcgcuggaggcgauaucugggucacaagagagcccuauguguccugugacccugauaagugcuaccaauuugcccucgggcagggaaccacacugaauaaccggcauucuaaugacaccguucacgaucgcacgccguauagaacacugcucaugaacgaacugggcgugcccuuccaucuugggaccaaacaggucuguaucgccuggagcuccagcucuugccacgacggaaaggcuuggcugcauguguguguuacaggccacgaugagaaugccaccgcuuccuuuauuuacgacggccggcucguggauagcaucgggucuugguccaaaaagauucugcgcacccaggaaagcgagugcgucuguaucaacggaacaugcacgguggugaugaccgacggcucugccuccgggagagcggauacaaaaauucuuuucaucgaggaaggaaagaucguccacauuagccaacugcucggcuccgcccagcauguugaggaaugcucuuguuauccucgguaccccggggugcgcugcguguguagagacaauuggaagggaagcaaccggccuaucgucgauauuaacgugaaagacuacuccaucguuagcucuuaugugugcuccggccuggucggcgacacaccccgcaagaaugauagcucuagcuccucucacugucugaacccgaauaacgaggaagggggacauggcgugaaagggugggcuuuugacgauggaaaugacguuuggaugggcagaaccauuagcgagaagcuccgguccggguacgagaccuucaaagugaucgaaggauggagcaagccuaacucuaaacugcagaucaaucgccaggucauuguggauagaggcaaccgguccggcuauagcgggaucuuuucugucgagggaaaguccugcauuaauagauguuucuacguggaacuuauccgcggccggaagcaagagacggaaguuugguggacaagcaacuccauuguggucuuuugcgggaccucuggaaccuauggcacagggagcuggcccgacggcgccgauaucaaucugaugccuauuuga

SEQ ID NO: 197941 - RNA, 1410 nt, Artificial Sequence
  derived and/or modified sequence opt5 from neuraminidase__InfluenzaA__ABD94946
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucaacggcacgugcaccguggugaugacagacgggucugccuccggaaaagcggauaccaagauucuguuuaucgaggagggcaagaucguccacacaagccuucuguccgggucugcccaacacguugaagagugcagcuguuauccucgcuaccccggagugagaugcgugugucgggacaacuggaaaggcuccaaucgcccuauugucgauaucaacgugaaggacuacagcauuguuucuuccuaugugugcagcggccucgucggggacacccccagaaagaaugaucggucuagcuccucucauugucuggacccgaacaaugaagagggaggccacggggugaaaggaugggcuuucgaugacggcaacgauguuuggauggggcgcacgaucagcgaaaaacugagauccggauacgagacauuuaaggugauugagggcuggagcaaaccuaauucuaagcuccagaucaaccggcaggucaucguggaccgcgauaauagauccggcuauagcgggauuuucucugucgaaggaaaguccugcaucaaccgguguuuuuacguggagcugauuagaggccgcaaucaggaaaccgagguucuuuggaccagcaacuccaucguggucuucugcgggacaucuggaaccuauggcacagggagcuggcccgacggcgccgauauuaaucugaugccuaucuga

SEQ ID NO: 197942 - RNA, 1410 nt, Artificial Sequence
  derived and/or modified sequence opt5 from neuraminidase__InfluenzaA__ABD94957
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaauccaagucuuguaucaacagaugcuuuuacguggagcugauucgggggagaaaggaagagaccgaaguucucuggaccagcaauuccaucguggucuucuguggaacaucuggcaccuaugggacaggaagcuggcccgacggcgcugauauuaaccugaugccuaucuga

SEQ ID NO: 197943 - RNA, 1413 nt, Artificial Sequence; identical to SEQ ID NO: 197852
  derived and/or modified sequence opt5 from neuraminidase__InfluenzaA__ABD94968

SEQ ID NO: 197944 - RNA, 1413 nt, Artificial Sequence; identical to SEQ ID NO: 197852
  derived and/or modified sequence opt5 from neuraminidase__InfluenzaA__ABD94990

SEQ ID NO: 197945 - RNA, 1413 nt, Artificial Sequence
  derived and/or modified sequence opt5 from neuraminidase__InfluenzaA__ABD95001
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugugaauauccauaacacaaauguuguggccggaaaagacaagaccucugugacacuggcgggcaacagcucccuuuguagcauuucugggugggcuaucuacaccaaagauaauuccauucggaucggaagcaagggcgacgucuucgugauucgcgaaccuuuuaucucuugcucccaccuggaguguagaacguucuuucucacccaaggcgcccugcuuaacgauaaacauagcaaugggacaguuaaggaccggucuccguaucgcgcccugauguccugcccccucggagaagcuccuagccccuacaacuccaaguucgagucuguggccuggagcgcuuccgccugucacgauggcaugggguggcugaccaucggaauuagcggcccugacaauggggcggucgccgugcugaaauauaacggaaucauuacagaaaccaucaagucuuggaaaaagcggauucucagaacgcaggaguccgagugcguuugugugaacggcagcugcuuuacaaucaugaccgauggccccucuaauggggcugccagcuacaaaaucuucaagauugaaaagggaaaagucacaaaguccaucgagcugaacgcuccuaauuuucacuaugaagaguguucuugcuacccggacaccggcaccgugaugugugugugccgcgauaacuggcaugggagcaauagacccugggucuccuucaaccagaaucuugacuaccagauuggauauaucugcagcggcguuuuuggggauaacccucggcccaaagacggagagggcucuuguaauccugugacaguggauggcgccgacggggucaagggauucuccuacaaauauggcaacgggguguggauuggacgcacgaaguccaauagacugcggaaaggcuuugaaaugaucugggaccccaacggguggaccgauacagacucuaauuucuccaugaagcaagauguuguggcgauuaccgacuggagcggcuacuccggaucuuuuguccagcacccggagcucacaggccuggauugcauccgcccuuguuucuggguggaacuuguuagagggcugccccgggagaacaccacgaucuggacaagcggauccucuauuagcuucugcggcgucaauuccgacaccgccaacuggagcuggccugauggggcugaacuccccuuuaccaucgacaaguga

SEQ ID NO: 197946 - RNA, 1413 nt, Artificial Sequence
  derived and/or modified sequence opt5 from neuraminidase__InfluenzaA__ABD95012
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccaacacagauucuaauuucuccguuaagcaagacguggucgcgauuaccgauuggagcggcuacuccggaucuuuugugcagcauccggagcucacaggccuggacugcauccgcccuuguuucuggguugaacuugugagagggcugccccgggagaacaccacgaucuggacaagcggauccucuauuagcuucugcggcgucaacuccgauaccgccaauuggagcuggccugacggggcugaacuccccuuuaccaucgauaaguga

SEQ ID NO: 197947 - RNA, 1413 nt, Artificial Sequence; identical to SEQ ID NO: 197852
  derived and/or modified sequence opt5 from neuraminidase__InfluenzaA__ABD95023

SEQ ID NO: 197948 - RNA, 1413 nt, Artificial Sequence
  derived and/or modified sequence opt5 from neuraminidase__InfluenzaA__ABD95034
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucuaacuucuccguuaagcaagauguggucgcgauuaccgacuggagcggcuacuccggaucuuuuauccagcauccggagcucacaggccuggauugcauccgcccuuguuucuggguggaacuuguuagagggcugccccgggagaauaccacgauuuggacaagcggauccucuaucagcuucugcggcgugaacuccgacaccgccaacuggagcuggccugauggggcugaacuccccuuuaccauugacaaguga

SEQ ID NO: 197949 - RNA, 1413 nt, Artificial Sequence
  derived and/or modified sequence opt5 from neuraminidase__InfluenzaA__ABD95056
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaaaucacaaaguccauugagcugaaugcuccuaacuuucacuaugaagaguguucuugcuacccggacaccggcaccgucaugugugugugccgggauaauuggcacgggagcaaccgccccuggguguccuucaaucagaaccuugacuaccaaaucggauauauuugcagcggcgucuuuggggauaauccuagacccaaagacggagagggcucuuguaacccuguuacaguggauggcgccaauggggugaagggauucuccuacaaauauggcaacggggucuggaucggacggacgaaguccaaucgccugagaaaaggcuuugaaaugauuugggaccccaacggguggaccgacacagauucugacuucuccgugaagcaggauguuguggcgaucaccgacuggagcggcuacuccggaucuuuuguccagcauccggagcucacaggccugaauugcauccggccuuguuucuggguggaacuuguucgcgggcugcccaaggagaacaccacgauuuggacaagcggauccucuaucagcuucugcggcgugaacuccgauaccgccaauuggagcuggccugacggggcugaacuccccuuuaccauugauaaauga

SEQ ID NO: 197950 - RNA, 1413 nt, Artificial Sequence; identical to SEQ ID NO: 197420
  derived and/or modified sequence opt5 from neuraminidase__InfluenzaA__ABD95067

SEQ ID NO: 197951 - RNA, 1413 nt, Artificial Sequence; identical to SEQ ID NO: 197420
  derived and/or modified sequence opt5 from neuraminidase__InfluenzaA__ABD95078

SEQ ID NO: 197952 - RNA, 1413 nt, Artificial Sequence; identical to SEQ ID NO: 197949
  derived and/or modified sequence opt5 from neuraminidase__InfluenzaA__ABD95089

SEQ ID NO: 197953 - RNA, 1413 nt, Artificial Sequence; identical to SEQ ID NO: 197420
  derived and/or modified sequence opt5 from neuraminidase__InfluenzaA__ABD95100

SEQ ID NO: 197954 - RNA, 1413 nt, Artificial Sequence
  derived and/or modified sequence opt5 from neuraminidase__InfluenzaA__ABD95111
augaaccccaaucagaagaucauuaccaucggcagcauuuccaucgccauugggaugaucucucugaugcuccaaaucggaaacauuaucagcauuugggcuucccacucuauccagacaggcagccagaaucauacgggggugugcaaccagagaauuaucaccuacgagaauagcacaugggucaaccacaccuauguuaauauuaacaauacaaacgugaucgccggaaaagacaagaccucugugacacuggcgggcaauagcucccuuuguagcaucucugggugggcuauuuacaccaaagauaacuccauccggauuggaagcaagggcgacgucuucgugauccgcgaaccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagcagauccucagaacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugacaguggauggcgccaauggggucaagggauucuccuacaaauauggcaacgggguguggaucggacggacgaaguccaaucgccugagaaaaggcuuugaaaugauuugggaccccaacggguggaccgacacagauucugacuucuccguuaagcaggauguggucgcgaucaccgacuggagcggcuacuccggaucuuuugugcagcauccggagcucacaggccuggauugcauucggccuuguuucuggguugaacuugugcgcgggcugcccaaggagaauaccacgaucuggacaagcggauccucuaucagcuucugcggcgucaacuccgacaccgccaacuggagcuggccugauggggcugaacuccccuuuaccauugacaaauga

SEQ ID NO: 197955 - RNA, 1413 nt, Artificial Sequence; identical to SEQ ID NO: 197954
  derived and/or modified sequence opt5 from neuraminidase__InfluenzaA__ABD95122

SEQ ID NO: 197956 - RNA, 1413 nt, Artificial Sequence; identical to SEQ ID NO: 197420
  derived and/or modified sequence opt5 from neuraminidase__InfluenzaA__ABD95144

SEQ ID NO: 197957 - RNA, 1413 nt, Artificial Sequence; identical to SEQ ID NO: 197420
  derived and/or modified sequence opt5 from neuraminidase__InfluenzaA__ABD95155

SEQ ID NO: 197958 - RNA, 1413 nt, Artificial Sequence
  derived and/or modified sequence opt5 from neuraminidase__InfluenzaA__ABD95166
augaaccccaaucagaagaucauuaccaucggcagcauuuccaucgccauugggaugaucucucugaugcuccaaaucggaaacauuaucagcauuugggcuucccacucuauccagacaggcagccagaaucauacgggggugugcaaccagagaauuaucaccuacgagaauagcacaugggucaaccacaccuauguuaauauuaacaauacaaacgugaucgccgaaaaagacaagaccucugugacacuggcgggaaauagcucccuuuguagcaucucuggcugggcuauuuacaccaaagauaacuccauccggauugggagcaagggagacgucuucgugauccgcgagccuuuuauuucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggaucagcggaccugacaacggcgcggucgccgugcugaaauauaacgggauuaucacagagaccauuaagucuuggaaaaagcagauccucagaacgcaggaguccgaaugcguuugugugaauggaagcugcuuuacaauuaugaccgauggccccucuaacggcgcugccagcuacaaaaucuucaagaucgagaaggggaaagucacaaaguccauugaacugaaugcuccuaacuuucacuaugaggaguguucuugcuacccggacaccggaaccgugaugugugugugccgggauaauuggcacggcagcaaccgccccugggucuccuucaaucagaaccuugacuaccaaaucggguauauuugcagcggaguuuuuggcgauaauccuagacccaaagacggggaaggaucuuguaacccugugacaguggauggcgccaauggcgucaagggguucuccuacaaauauggaaacggcguguggaucgggcggacgaaguccaaucgccugagaaaaggauuugagaugauuugggaccccaacggcuggaccgacacagauucugacuucuccguuaagcaggauguggucgcgaucaccgacuggagcggguacuccggcucuuuugugcagcauccggaacucacaggacuggauugcauucggccuuguuucuggguugagcuugugcgcggccugcccaaggaaaauaccacgaucuggacaagcggguccucuaucagcuucugcggagucaacuccgacaccgccaacuggagcuggccugauggcgcugagcuccccuuuaccauugacaaauga

SEQ ID NO: 197959 - RNA, 1413 nt, Artificial Sequence; identical to SEQ ID NO: 197949
  derived and/or modified sequence opt5 from neuraminidase__InfluenzaA__ABD95177

SEQ ID NO: 197960 - RNA, 1413 nt, Artificial Sequence
  derived and/or modified sequence opt5 from neuraminidase__InfluenzaA__ABD95188
augaaccccaaucagaagaucauuaccaucggcagcauuuccacaacgaucgggauuaucucucugaugcuccaaaucggaaacauuaucagcauuugggccucccacucuauccagaccggcagccagaaucauacaggggugugcaaccagagaauuaucaccuacgaaaauuccacaugggucaaccacaccuauguuaauauuaacaauacaaacgugaucgcuggaaaagacaagaccucugugacgcuggccggcaauagcucccuuuguagcaucucugggugggcgauuuacaccaaagauaacuccauccggauuggaagcaagggcgacgucuucgugauccgcgagccuuuuauuucuugcucccaucuggaguguagaacauucuuucucacccaaggcgcucugcuuaaugauaaacacagcaacgggacaguuaaggaccggucuccguaucgcgcccugauguccugcccccucggagaagccccuagccccuacaauuccaaguucgagucuguggcuuggagcgccuccgcuugucaugauggcaugggguggcugaccaucggaaucagcggcccugacaacggggccgucgcggugcugaaauauaacggaauuaucacggaaacaauuaagucuuggaaaaagcagauccucagaacccaggaguccgagugcguuugugugaauggcagcugcuuuacaauuaugaccgauggccccucuaacggggccgcuagcuacaaaaucuucaagaucgaaaagggaaaagucaccaaguccauugagcugaaugccccuaacuuucacuaugaagaguguucuugcuacccggacacaggcacggugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugaccguggauggcgcuaauggggucaagggauucuccuacaaauauggcaacgggguguggaucggacggacaaagagcaaucgccugagaaaaggcuuugaaaugauuugggaccccaacggguggaccgacacagauucugacuucuccguuaagcaggauguggucgccaucaccgacuggagcggcuacuccggaucuuuugugcagcauccggagcucacgggccuggauugcauucggccuuguuucuggguugaacuugugcgcgggcugcccaaggagaauacaaccaucuggaccagcggauccucuaucagcuucugcggcgucaacuccgacacagcgaacuggagcuggccugauggggccgaacuccccuuuaccauugacaaauga

SEQ ID NO: 197961 - RNA, 1413 nt, Artificial Sequence; identical to SEQ ID NO: 197949
  derived and/or modified sequence opt5 from neuraminidase__InfluenzaA__ABD95199

SEQ ID NO: 197962 - RNA, 1413 nt, Artificial Sequence; identical to SEQ ID NO: 197439
  derived and/or modified sequence opt5 from neuraminidase__InfluenzaA__ABD95210

SEQ ID NO: 197963 - RNA, 1413 nt, Artificial Sequence
  derived and/or modified sequence opt5 from neuraminidase__InfluenzaA__ABD95221
augaaccccaaucagaagaucauuaccaucggcagcauuuccaucgccauugggaugaucucucugaugcuccaaaucggaaacauuaucagcauuugggcuucccacucuauccagacaggcagccagaaucauacgggggugugcaaccagagaauuaucaccuacgagaauagcacaugggucaaccacaccuauguuaauauuaacaauacaaacgugaucgccggaaaagacaagaccucugugacacuggcgggcaauagcucccuuuguagcaucucugggugggcuauuuacaccaaagauaacuccauccggauuggaagcaagggcgacgucuucgugauccgcgaaccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagcagauccucagaacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacucucacuaugaagaguguagcugcuacccggacaccggcaccgugaugugugugugccgggauaauuggcacggguccaaccgccccugggucagcuuuaaucagaaccuugacuaccaaaucggauauauuugcucuggcguuuucggggauaauccuagacccaaagacggagagggcuccuguaacccugugacaguggauggcgccaauggggucaagggauuuagcuacaaauauggcaacgggguguggaucggacggacgaagucuaaucgccugagaaaaggcuucgaaaugauuugggaccccaacggguggaccgacacagauuccgacuuuagcguuaagcaggauguggucgcgaucaccgacugguccggcuacucuggauccuucgugcagcauccggagcucacaggccuggauugcauucggccuuguuuuuggguugaacuugugcgcgggcugcccaaggagaauaccacgaucuggacauccggaucuagcaucuccuucugcggcgucaacagcgacaccgccaacuggucuuggccugauggggcugaacuccccuucaccauugacaaauga

SEQ ID NO: 197964 - RNA, 1413 nt, Artificial Sequence; identical to SEQ ID NO: 197954
  derived and/or modified sequence opt5 from neuraminidase__InfluenzaA__ABD95232

SEQ ID NO: 197965 - RNA, 1413 nt, Artificial Sequence; identical to SEQ ID NO: 197420
  derived and/or modified sequence opt5 from neuraminidase__InfluenzaA__ABD95243

SEQ ID NO: 197966 - RNA, 1413 nt, Artificial Sequence; identical to SEQ ID NO: 197954
  derived and/or modified sequence opt5 from neuraminidase__InfluenzaA__ABD95254

SEQ ID NO: 197967 - RNA, 1413 nt, Artificial Sequence; identical to SEQ ID NO: 197439
  derived and/or modified sequence opt5 from neuraminidase__InfluenzaA__ABD95265

SEQ ID NO: 197968 - RNA, 1413 nt, Artificial Sequence; identical to SEQ ID NO: 197420
  derived and/or modified sequence opt5 from neuraminidase__InfluenzaA__ABD95276

SEQ ID NO: 197969 - RNA, 1413 nt, Artificial Sequence
  derived and/or modified sequence opt5 from neuraminidase__InfluenzaA__ABD95287
augaaccccaaucagaagaucauuaccaucggcagcauuuccguggccaucgggauuaucucucugaugcuccaaaucggaaacauuaucagcauuugggcuucccacucuauccagacaggcagccagaaucauacgggggucugcaaccagagaauuaucaccuacgagaauagcacauggguuaaccacaccuaugugaauauuaacaauacaaacgugaucgccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagcagauccucagaacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgggauaauuggcacgggagcaaccgccccuggguuuccuucaaucagaaccuugacuaccaaaucggauauauuugcagcggcguguuuggggauaauccuagacccaaagacggagagggcucuuguaacccugugacagucgauggcgccaauggggugaagggauucuccuacaaauauggcaacgggguuuggaucggacggacgaaguccaaucgccugagaaaaggcuuugaaaugauuugggaccccaacggguggaccgacacagauucugacuucuccgugaagcaggaugucguggcgaucaccgacuggagcggcuacuccggaucuuuuguucagcauccggagcucacaggccuggauugcauucggccuuguuucuggguggaacuuguccgcgggcugcccaaggagaauaccacgaucuggacaagcggauccucuaucagcuucugcggcgugaacuccgacaccgccaacuggagcuggccugauggggcugaacuccccuuuaccauugacaaauga

SEQ ID NO: 197970 - RNA, 1413 nt, Artificial Sequence; identical to SEQ ID NO: 197420
  derived and/or modified sequence opt5 from neuraminidase__InfluenzaA__ABD95298

SEQ ID NO: 197971 - RNA, 1413 nt, Artificial Sequence
  derived and/or modified sequence opt5 from neuraminidase__InfluenzaA__ABD95309
augaaccccaaucagaagaucauuaccaucggcagcauuuccaucgccauugggaugaucucucugaugcuccaaaucggaaacauuaucagcauuugggcuucccacucuauccagacaggcagccagaaucauacgggggugugcaaccagagaauuaucaccuacgaaaauuccacaugggucaaccacaccuauguuaauauuaacaauacaaacgugaucgccggaaaagacaagaccucugugacacuggcgggcaauagcucccuuuguagcaucucugggugggcuauuuacaccaaagauaacuccauccggauuggaagcaagggcgacgucuucgugauccgcgagccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagcagauccucagaacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugacaguggauggcgccaauggggucaagggauucuccuacaaauauggcaacgggguguggaucggacggacgaagugcaaucgccugagaaaaggcuuugaaaugauuugggaccccaacggguggaccgacacagauagcgacuucucuguuaagcaggauguggucgcgaucaccgacugguccggcuacagcggauccuuugugcagcauccggagcucacaggccuggauuguauucggccuugcuucuggguugaacuugugcgcgggcugcccaaggagaauaccacgaucuggacaucuggaagcuccaucucuuucuguggcgucaacagcgacaccgccaacugguccuggccugauggggcugaacuccccuuuaccauugacaaauga

SEQ ID NO: 197972 - RNA, 1413 nt, Artificial Sequence; identical to SEQ ID NO: 197420
  derived and/or modified sequence opt5 from neuraminidase__InfluenzaA__ABD95320

SEQ ID NO: 197973 - RNA, 1413 nt, Artificial Sequence; identical to SEQ ID NO: 197949
  derived and/or modified sequence opt5 from neuraminidase__InfluenzaA__ABD95331

SEQ ID NO: 197974 - RNA, 1413 nt, Artificial Sequence
  derived and/or modified sequence opt5 from neuraminidase__InfluenzaA__ABD95342
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucaacaauacaaacgugguggcuggaaaagacaccacauccgucacccuggccggcaauucuagccuuugcccugugcgggggugggcgauuuacuccaaggauaacagcauccgcauuggaucuaaaggcgacguuuucgugaucagagaaccguuuauuuccuguagccaccuggagugccggacguucuuucucacccagggcgcucugcuuaaugauaagcauucuaacgggacagucaaagaccgcucccccuauagagcccugaugagcuguccuaucggagaagcccccucuccuuacaauucccgguucgagagcguggcuugguccgccucugcuugccacgauggcaugggguggcucaccaucggaauuagcggccccgacgauggggccguugcggugcugaaguauaacggaaucauuacagaaaccaucaaguccuggcgcaaacggauucugagaacgcaggagagcgagugugucugcaucaacggcucuuguuuuacaaucaugaccgacggcccuuccaaugggccggccagcuaccgcauuuucaagaucgaaaaaggaaagauuacaaaaucuaucgagcucgaugcucccaacagccauuaugaagagugcuccuguuacccugacaccggcaccgugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcggcccggugacaguggacggggccgauggagucaaaggcuuuucuuacagauaugggaacggaguguggauuggccggacgaaguccaauagcucucgcaaaggguucgagaugaucugggacccuaacggcuggaccgauacagacuccaauuuucuuguuaagcaggauguggucgcuaugaccgacuggagcggauacuccggcucuuucgugcagcaccccgaacugacagggcucgauuguaugagaccuugcuuuuggguugagcugauccggggaagaccccgcgagaaaaccacgauuuggacaagcggcuccucuaucagcuucuguggggugaacuccgacaccgucaauuggagcuggcccgauggagccgaacuuccuuucaccauugacaaguga

SEQ ID NO: 197975 - RNA, 1413 nt, Artificial Sequence
  derived and/or modified sequence opt5 from neuraminidase__InfluenzaA__ABD95353
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugcugaaguauaauggaauuaucacagaaaccauuaagagcuggcgcaaacagauccugagaacgcaggagucugaguguguuugcgugaacggcuccuguuuuacaaucaugaccgacggcccuagcgaugggccggccucuuaccggauuuucaagaucgaaaaaggaaagauuacaaaaagcaucgagcucgacgcucccaacucccauuaugaagagugcucuuguuacccugauaccggcaccgucaugugcgugugccgcgacaauuggcacgggagcaacagacccuggguguccuuuaaucaaaaccuggauuaccagauuggauauaucuguagcggcgucuucggggacaauccucggcccaaggacggaaagggcucuugcgauccgguuaacguggacggcgccgauggggugaaaggauuuuccuaccgcuauggcaauggggucuggauuggaagaacaaagagcaacucuucccggaaaggcuucgagaugaucugggacccuaauggguggacggauaccgacagcaacuuucuugugaagcaggauguuguggcuaugacagacugguccggcuacucuggcagcuucguccagcaccccgaacugaccggacucgauuguaugcgcccuugcuuuuggguggagcugaucagagggcggcccagagagaaaacaaccauuuggacguccggaucuagcaucuccuucuguggcguuaauagcgacacagugaacuggucuuggcccgauggggccgaacuuccuuucaccauugacaaguga

SEQ ID NO: 197976 - RNA, 1413 nt, Artificial Sequence; identical to SEQ ID NO: 197852
  derived and/or modified sequence opt5 from neuraminidase__InfluenzaA__ABE11660

SEQ ID NO: 197977 - RNA, 1413 nt, Artificial Sequence
  derived and/or modified sequence opt5 from neuraminidase__InfluenzaA__ABE11671
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgagccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagcagauccucagaacgcaggaguccgagugcgugugugucaauggcagcugcuuuacaauuaugaccgauggccccucuaacggggcugccagcuacaaaaucuucaagaucgaaaagggaaaagugaauaaguccauugagcugaacgcuccuaauuuucacuaugaagaguguucuugcuacccggacacaggcaccgugaugugugucugccgggauaacuggcacgggagcaaucgccccuggguuuccuucaaccagaaucuugacuaccaaaucggauauauuugcagcggcguguuuggggauaacccuagacccaaagacggagagggcucuuguaauccugugaccgucgauggcgccaacggggugaagggauucuccuacaaauauggcaaugggguuuggaucggacggacaaagagcaaccgccugagaaaaggcuuugaaaugauuugggaccccaauggguggacggacaccgauucugacuucuccgugaagcaggaugucguggcgaucacagacuggagcggcuacuccggaucuuuuguucagcauccggagcucaccggccuggauugcauucggccuuguuucuggguggaacuuguccgcgggcugcccagagagaacacaaccaucuggacgagcggauccucuaucagcuucugcggcgugaacuccgacacagccaauuggagcuggccugauggggcugaacuccccuuuaccauugacaaguga

SEQ ID NO: 197978 - RNA, 1413 nt, Artificial Sequence
  derived and/or modified sequence opt5 from neuraminidase__InfluenzaA__ABE11682
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggagaggacaaaaccucugugacacuggcgggcaauagcucccuuuguagcauuucugggugggcuaucuacaccaaggauaacuccauucggaucggaagcaaaggcgacgucuucgugauucgcgagccuuuuaucucuugcucccaucuggaauguagaacguucuuucucacccaaggcgcccugcuuaaugauaagcacagcaacgggacaguuaaagaccggucuccguaucgcgcccugauguccugcccccucggagaggcuccuagccccuacaauuccaaguucgaaucuguggccuggagcgcuuccgccugucaugauggcaugggguggcugaccaucggaauuagcggcccugacaacggggcggucgccgugcugaaguauaacggaaucauuacagagaccaucaaaucuuggaagaaacggauucucagaacgcaggaguccgaaugcguuugugugaauggcagcugcuuuacaaucaugaccgauggccccucuaacggggcugccagcuacaagaucuucaaaauugagaagggaaaggucacaaaauccaucgaacugaaugcuccuaacuuucacuaugaggaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaggacggagaaggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaaacaagacguggucgcgauuaccgauuggagcggcuacuccggaucuuuugugcagcauccggaacucacaggccuggacugcauccgcccuuguuucuggguugagcuugugagagggcugccccgggaaaacaccacgaucuggacaagcggauccucuauuagcuucugcggcgucaauuccgauaccgccaacuggagcuggccugacggggcugagcuccccuuuaccaucgauaaguga

SEQ ID NO: 197979 - RNA, 1413 nt, Artificial Sequence; identical to SEQ ID NO: 197420
  derived and/or modified sequence opt5 from neuraminidase__InfluenzaA__ABE11693

SEQ ID NO: 197980 - RNA, 1413 nt, Artificial Sequence; identical to SEQ ID NO: 197420
  derived and/or modified sequence opt5 from neuraminidase__InfluenzaA__ABE11704

SEQ ID NO: 197981 - RNA, 1413 nt, Artificial Sequence; identical to SEQ ID NO: 197420
  derived and/or modified sequence opt5 from neuraminidase__InfluenzaA__ABE11715

SEQ ID NO: 197982 - RNA, 1413 nt, Artificial Sequence; identical to SEQ ID NO: 197949
  derived and/or modified sequence opt5 from neuraminidase__InfluenzaA__ABE11726

SEQ ID NO: 197983 - RNA, 1413 nt, Artificial Sequence; identical to SEQ ID NO: 197954
  derived and/or modified sequence opt5 from neuraminidase__InfluenzaA__ABE11737

SEQ ID NO: 197984 - RNA, 1413 nt, Artificial Sequence; identical to SEQ ID NO: 197420
  derived and/or modified sequence opt5 from neuraminidase__InfluenzaA__ABE11815

SEQ ID NO: 197985 - RNA, 1413 nt, Artificial Sequence; identical to SEQ ID NO: 197949
  derived and/or modified sequence opt5 from neuraminidase__InfluenzaA__ABE11826

SEQ ID NO: 197986 - RNA, 1413 nt, Artificial Sequence; identical to SEQ ID NO: 197949
  derived and/or modified sequence opt5 from neuraminidase__InfluenzaA__ABE11837

SEQ ID NO: 197987 - RNA, 1413 nt, Artificial Sequence; identical to SEQ ID NO: 197949
  derived and/or modified sequence opt5 from neuraminidase__InfluenzaA__ABE11848

SEQ ID NO: 197988 - RNA, 1413 nt, Artificial Sequence; identical to SEQ ID NO: 197954
  derived and/or modified sequence opt5 from neuraminidase__InfluenzaA__ABE11859

SEQ ID NO: 197989 - RNA, 1413 nt, Artificial Sequence
  derived and/or modified sequence opt5 from neuraminidase__InfluenzaA__ABE11903
augaaccccaaucagaagaucauuaccaucggcagcauuuccauggccaucgggauuaucucucugauccuccaaauuggaaacaucauuagcaucugggcuucccacucuauucagacaggcagccagaauuacacggggaucugcaaccagagaauuaucaccuaugagaauagcacaugggugaaccaaaccuacgucaauaucaacaauacaaacguuguggccggaaaagacaagaccucuaugacacuggcgggcaauagcucccuuuguccuauucgggggugggcuaucuauaccaaagauaacagcauucgcaucggaucuaagggcgacguguucgucauuagagaaccguuuaucuccugcagccaucuggagugucggacguucuuucucacccagggcgcccugcuuaaugauaaacacucuaacgggacagugaaggaccgcucccccuacagagcccugaugagcugcccucucggagaagcucccucuccuuauaauucccgguucgagagcguugccugguccgcuucugccugucaugauggccugggguggcugaccaucggaauuagcggccccgacaacggggcgguggccguccucaaguacaacggaaucauuacagaaaccaucaaauccuggaagaaacagauucugcgcacgcaggagagcgagugcguguguguuaauggcucuugcuuuacaaucaugaccgauggcccuuccaacggggcugccagcuauagaaucuucaagauugaaaaaggacgggugacaaagucuaucgagcuugacgcuccgaauuaccacuacgaagaguguagcugcuaucccgauaccggcaccgucaugugugugugccgcgacaacuggcauggguccaauagaccuugggugucuuuuaaccaaaaucuggauuaccagauuggauauaucugcagcggcgucuucggggacaacccccggccuaaggauggagagggcuccuguaaucccguuacaguggacggcgccgacggggugaaaggauuuagcuaccgcuauggcaacggggucuggauuggaagaacgaagucuaaucggcuccgcaaaggcuucgaaaugaucugggauccgaacggguggaccgacacagauuccgacuuuagcaugaagcaggaugugguugcgaugaccgacuggucuggcuacuccggauccuucgugcagcacccugagcugacaggccuugauugcaugagacccuguuuuugggucgaacuggugcgggggcucccuagagagaauaccacgauuuggacauccggaucuagcaucuccuucugcggcguuaacucugaaaccgccaauuggagcuggcccgacggggcugagcugcccuucaccaucgauaaauga

SEQ ID NO: 197990 - RNA, 1413 nt, Artificial Sequence
  derived and/or modified sequence opt5 from neuraminidase__InfluenzaA__ABE11925
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggaaagguuacaaagucuauugagcuugacgcuccgaauuaucauuacgaagaguguagcugcuaccccgauaccggcaccgugaugugugucugccgcgacaacuggcacggguccaauagaccuugggugucuuuuaaccagaaucuggauuaucaaaucggauacauuugcagcggcguguucggggacaacccccggccuaaagauggagagggcuccuguaaucccgucacagccgacggcgcggacgggguuaagggauuuagcuaucgcuacggcaacgggguguggaucggaagaacgaaaucuaaucggcuccgcaagggcuucgaaaugauuugggauccgaacggguggaccgacacagauuccgacuuuagcaugaaacaggauaucguggccaugaccgacuggucuggcuauuccggauccuucguccagcacccugagcugacaggccuugauugcaugagacccuguuuuuggguggaacugguucgggggcucccuagagagaauaccacgaucuggacauccggaucuagcauuuccuucugcggcgugaacucugacaccgcuaauuggagcuggcccgauggggccgaacugcccuucaccaucgacaaguga

SEQ ID NO: 197991 - RNA, 1413 nt, Artificial Sequence
  derived and/or modified sequence opt5 from neuraminidase__InfluenzaA__ABE11952
augaaccccaaucagaagaucauuaccaucggcagcauuuccauggccaucgggauuaucucucugauccuccaaauuggaaacaucauuagcaucugggcuucccacucuauucagacaggcagccagaauuacacggggaucugcaaccagagaauuaucaccuaugagaauagcacaugggugaaccaaaccuacgucaauaucaacaauacaaacguuguggccggaaaagacaagaccucuaugacacuggcgggcaauagcucccuuuguccuauucgggggugggcuaucuauaccaaagauaacagcauucgcaucggaucuaagggcgacguguucgucauuagagaaccguuuaucuccugcagccaucuggagugucggacguucuuucucacccagggcgcccugcuuaaugauaaacacucuaacgggacagugaaggaccgcucccccuacagagcccugaugagcugcccucucggagaagcucccucuccuuauaauucccgguucgagagcguugccugguccgcuucugccugucaugauggccugggguggcugaccaucggaauuagcggccccgacaacggggcgguggccguccucaaguacaacggaaucauuacagaaaccaucaaauccuggaagaaacagauucugcgcacgcaggagagcgagugcguguguguuaauggcucuugcuuuacaaucaugaccgauggcccuuccaacggggcugccagcuauagaaucuucaagauugaaaaaggacgggugacaaagucuaucgagcuugacgcuccgaauuaccacuacgaagaguguagcugcuaucccgauaccggcaccgucaugugugugugccgcgacaacuggcauggguccaauagaccuugggugucuuuuaaccaaaaucuggauuaccagauuggauauaucugcagcggcgucuucggggacaacccccggccuaaggauggagagggcuccuguaaucccguuacaguggacggcgccgacggggugaaaggauuuagcuaccgcuauggcaacggggucuggauuggaagaacgaagucuaaucggcuccgcaaaggcuucgaaaugaucugggauccgaacggguggaccgacacagauuccgacuuuagcaugaagcaggaugugguugcgaugaccgacuggucuggcuacuccggauccuucgugcagcacccugagcugacaggccuugauugcaugagacccuguuuuugggucgaacuggugcgggggcucccuagagagaauaccacgauuuggacauccggaucuagcaucuccuucugcggcguuaacucugaaaccgccgacuggagcuggcccgauggggcugagcugcccuucaccaucgacaaauga

SEQ ID NO: 197992 - RNA, 1413 nt, Artificial Sequence
  derived and/or modified sequence opt5 from neuraminidase__InfluenzaA__ABE12035
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccgauaccggcaccgugaugugugucugcagagacaacuggcacggguccaaucggccuugggugucuuuuaaccagaaucuggauuaucaaaucggauacauuugcagcggcguguucggggacaacccccgcccuaaggauggagagggcuccuguaaucccgucacaguugacggcgccgacggggugaaaggauuuagcuauagauacggcaacgggguguggaucggacggacgaagucuaaucgccucagaaaaggcuucgaaaugauuugggauccgaacggguggaccgacacagauuccgacuuuagcaugaagcaggauaucgucgcgaugaccgacuggucuggcuauuccggauccuucgugcagcacccugagcugacaggccuugauugcaugcggcccuguuuuuggguugaacuggugagagggcucccucgcgagaauaccacgaucuggacauccggaucuagcauuuccuucugcggcgucaacucugacaccgccaauuggagcuggcccgauggggcugaacugcccuucaccaucgacaaauga

SEQ ID NO: 197993 - RNA, 1410 nt, Artificial Sequence; identical to SEQ ID NO: 197754
  derived and/or modified sequence opt5 from neuraminidase__InfluenzaA__ABE12094

SEQ ID NO: 197994 - RNA, 1410 nt, Artificial Sequence; identical to SEQ ID NO: 197886
  derived and/or modified sequence opt5 from neuraminidase__InfluenzaA__ABE12126

SEQ ID NO: 197995 - RNA, 1413 nt, Artificial Sequence; identical to SEQ ID NO: 197420
  derived and/or modified sequence opt5 from neuraminidase__InfluenzaA__ABE12263

SEQ ID NO: 197996 - RNA, 1410 nt, Artificial Sequence
  derived and/or modified sequence opt5 from neuraminidase__InfluenzaA__ABE12626
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaaguggagcaaaccccagugcaagauuacgggguucgcgccuuuuuccaaggauaacucuauccgccugagcgcuggaggcgacaucugggugaccagagagcccuauguuuccugugauccugggaaaugcuaccaauucgcccuuggacagggcacaacccuggacaauaagcauucuaacgauacaauucacgaccggaucccgcaucgcacccuccugaugaaugaacugggggugcccuuucaccucggaacgagacaggucuguauugccuggagcuccagcucuugccaugauggcaaggcuuggcugcacguguguguuacaggcgacgauaaaaacgccaccgcuuccuucaucuaugacgggcggcuuguggauagcauuggaucuuggucccagaauauccugcgcacacaagagagcgaaugcgucuguaucaacggaaccugcaccguggugaugacagacgggucugccuccggcagagcggauacgcggauucucuuuaucgaggagggcaaaauuguccacaucagcccucuguccgggucugcccagcauguugaagagugcagcuguuacccccgcuauccuggagugagaugcauuugucgggacaauuggaagggcuccaaccgccccguggucgacaucaaugugaaggauuacagcaucgacucuuccuacguuugcagcggccuugugggggauaccccgagaaacaacgaccggucuagcaauuccuauugucgcaacccuaauaacgaaagaggaaaucacggcgucaaagggugggcuuucgaugacggaaacgauguguggaugggccggacaauuucuaaggacagcagauccggguacgagaccuuuaaaguuaucggaggcuggagcacacccaauucuaagucccagauuaaccgccaggugaucgucgauagcgacaaucggucuggcuauuccgggauuuucagcguggaaggaaaauccugcaucaacagauguuuuuacgucgagcugauucgcggccgggagcaagaaaccagagugugguggacgucuaauagcaucguuguguucugcgggacauccggaaccuauggcaccgggucuuggccugauggcgccgacaucaaccucaugcccauuuga

SEQ ID NO: 197997 - RNA, 1410 nt, Artificial Sequence
  derived and/or modified sequence opt5 from neuraminidase__InfluenzaA__ABE12650
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucaaggagggaaagaucguccacauuagcccucuucugggcuccgcccaacauguugaagagugcucuuguuauccccgguacccuggggugcgcugcguguguagagacaauuggaaaggaagcaaccggcccaucgucgauauuaacgugaaggacuacuccaucguuagcucuuaugugugcuccggccucgucggcgacaccccgcgcaaaaaugauagcucuagcuccucucacugucugaacccuaauaacgaagaagggggacauggcgugaaggggugggcuuucgacgauggaaaugacguuuggaugggcagaacaauuagcgagaaacugcgguccggguacgagaccuuuaaggugaucgagggauggagcaaacccaacucuaagcuccagaucaaucgccaggucauuguggauagaggcaaccgguccggcuauagcgggaucuucucugucgaaggaaaguccugcauuaauagauguuuuuacguggagcugauccgcggccggaaacaggaaacggagguuugguggacaagcaacuccauuguggucuucugcgggaccucuggaaccuauggcacagggagcuggccugacggcgccgauaucaaucuuaugcccauuuga

SEQ ID NO: 197998 - RNA, 1410 nt, Artificial Sequence
  derived and/or modified sequence opt5 from neuraminidase__InfluenzaA__ABE13095
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccggcagagccgauacaaagauccuguuuaucgaggaaggaaaaauuguccacaucagcccucuuuccgggucugcgcaacauguugaggaauguagcugcuacccccgguauccuggagugcgcugugugugcagagacaacuggaagggcuccaaucggcccauugucgauaucaacgugaaggacuacagcauuguuucuuccuacguguguagcggccuggucggggauaccccgcgcaaaaaugacggaucuagcuccucuuauugccucgacccuaacaaugaggaaggcgggcacggagugaagggcugggccuucgaugacgggaacgauguuuggaugggaagaacaaucagcgagaaacugcgguccggcuacgagaccuuuaaggugaucggcggguggagcaaacccaauucuaagcugcagauuaaccgccaggucaucguggacaaaggaaauagauccggcuauagcgggauuuucucugucgaaggaaaguccuguaucaaccggugcuuuuacguggagcucauuagaggccgcaagcaggaaacggagguuugguggacaagcaauuccaucguggucuucugugggaccucuggcaccuauggaacaggcagcuggccugauggggcugacauuaaccugaugcccaucuga

SEQ ID NO: 197999 - RNA, 1410 nt, Artificial Sequence; identical to SEQ ID NO: 197150
  derived and/or modified sequence opt5 from neuraminidase__InfluenzaA__ABE13332

SEQ ID NO: 198000 - RNA, 1410 nt, Artificial Sequence; identical to SEQ ID NO: 197150
  derived and/or modified sequence opt5 from neuraminidase__InfluenzaA__ABE13558

SEQ ID NO: 198001 - RNA, 1410 nt, Artificial Sequence
  derived and/or modified sequence opt5 from neuraminidase__InfluenzaA__ABE13642
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaacgcacgccguauagaacacugcugaugaacgagcucggggugcccuuucaucugggaaccaaacaggucuguaucgccuggagcuccagcucuugccacgacggcaaggcuuggcuucauguguguguuacaggccacgaugaaaaugccaccgcuuccuucauuuacaacgggcggcugguggacagcaucggaucuugguccaaaaauauucuccgcacccaggagagcgagugcgucuguaucaacggcacaugcacgguggugaugaccgaugggucugccuccggcagagcggacacaaagauucuguuuaucgaagagggaaaaaucguccacauuagcccucuuuccgggucugcccaacauguugaagagugcagcuguuauccccgguacccuggagugcgcugcguguguagagauaacuggaagggcuccaaucggcccaucgucgacauuaacgugaaggauuacagcaucguuucuuccuaugugugcagcggccuggucggggacaccccgcgcaaaaaugauucuagcuccucuagccacugucucaacccuaauaacgaagagggaggccauggggugaagggaugggcuuucgacgacggcaaugauguuuggauggggagaacaauuuccgagaaacugcggagcggauacgaaaccuuuaaggugaucggcggcuggucuaaacccaacuccaagcugcagaucaaucgccaggucauuguggacagagggaaccggagcggauauucuggcaucuucuccgucgaggggaaaagcugcauuaauagauguuuuuacguggaacucauccgcggacggaagcaggagacggaaguuugguggacauccaacucuauuguggucuucugcggcaccagcgggaccuauggcacaggauccuggccugauggcgccgacaucaaucugaugcccauuuga

SEQ ID NO: 198002 - RNA, 1410 nt, Artificial Sequence
  derived and/or modified sequence opt5 from neuraminidase__InfluenzaA__ABE13668
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccggcagagcggacacaaagauucuguuuaucgaggaaggaaaaaucguccacauuagcccucuuuccgggucugcccaacauguugaggaaugcagcuguuauccccgguacccuggagugcgcugcguguguagagauaacuggaagggcuccaaccggcccaucgucgacauuaaugugaaggauuacagcaucguuucuuccuaugugugcagcggccuggucggggacaccccgcgcaaaaacgacucuagcuccucuagccacugucucaauccuaacaaugaggaaggaggccauggggugaagggaugggcuuucgaugacggcaacgauguuuggauggggagaacaauuuccgagaaacugcggagcggauacgagaccuuuaaggugaucggcggcuggucuaaacccaauuccaagcugcagaucaaccgccaggucauuguggacagagggaaucggagcggauauucuggcaucuucuccgucgaagggaaaagcugcauuaacagauguuuuuacguggagcucauccgcggacggaagcaggaaacggagguuugguggacauccaauucuauuguggucuucugcggcaccagcgggaccuauggcacaggauccuggccugauggcgccgacaucaaccugaugcccauuuga

SEQ ID NO: 198003 - RNA, 1410 nt, Artificial Sequence
  derived and/or modified sequence opt5 from neuraminidase__InfluenzaA__ABE13836
augaaccccaaucagaagaucauuaccaucggcagcgugucccugacaauugccacgaucugcuuccucaugcaaauugcuauccuggucaccacaguuacccuucacuuuaaacaguacgaguguaacucucugccuaauaaccaggugaugcucugcgaaccgacaaucauugagagaaauaucaccgaaauuguguaucugacaaacaccacgaucgagaaggaaauuugucccaaacuugccgaguaccggaauuggagcaagccucagugcaaaaucaccggguucgcgcccuuuuccaaggacaacucuauucgccugagcgcuggaggcgauaucugggucacaagagagccuuauguguccugugaccccgggaagugcuaccaauucgcccucggacagggcaccacacugaauaaccggcauucuaaugauaccguucacgaccgcacgccuuauagaacacugcucaugaacgaacugggggugccguuucaucuuggaaccaaacaggucuguaucgccuggagcuccagcucuugccacgauggcaaggcuuggcugcauguguguguuacaggccacgacgagaaugccaccgcuuccuucauuuacgaugggcggcucguggacagcaucggaucuugguccaaaaacauucugcgcacccaggaaagcgagugcgucuguaucaauggcacaugcacgguggugaugaccgaugggucugccuccggcagagcggacacaaagauucuuuuuaucgaggaaggaaaaaucguccacauuagcccccuguccgggucugcccaacauguugaggaaugcagcuguuauccucgguaccccggagugcgcugcguguguagagauaacuggaagggcuccaaccggccuaucgucgacauuaaugugaaggauuacagcaucguuucuuccuaugugugcagcggccucgucggggacacaccccgcaaaaacgacucuagcuccucuagccacugucugaauccgaacaaugaggaaggaggccauggggugaagggaugggcuuucgaugacggcaacgauguuuggauggggagaaccauuuccgagaaacugcggagcggauacgagaccuuuaaggugaucggcggcuggucuaaaccuaauuccaagcuccagaucaaccgccaggucauuguggacagagggaaucggagcggauauucuggcaucuucuccgucgaagggaaaagcugcauuaacagauguuuuuacguggagcugauccgcggacggaagcaggaaacggagguuugguggacauccaauucuauuguggucuucugcggcaccagcgggaccuauggcacaggauccuggcccgauggcgccgacaucaaccuuaugccuauuuga

SEQ ID NO: 198004 - RNA, 1410 nt, Artificial Sequence
  derived and/or modified sequence opt5 from neuraminidase__InfluenzaA__ABE14033
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccggcagagcggacacaaagauucuguuuaucgaggaaggaaaaaucguccacauuagcccucuuuccgggucugcccaacauguugaggaaugcagcuguuauccccgguacccuggagugcgcugcguguguagagauaacuggaagggcuccaaccggcccaucgucgacauuaaugugaaggauuacagcaucguuucuuccuaugugugcagcggccuggucggggacaccccgcgcaaaaacgacucuagcuccucuagcuacugucucaauccuaacaaugaggaaggaggccacggggugaagggaugggcuuucgaugacggcaacgauguuuggauggggagaacaauuuccgagaaacugcggagcggauaugagaccuuuaaggugaucggcggcuggucuaaacccaauuccaagcugcagaucaaccgccaggucauuguggacagagggaaucggagcggauacucuggcaucuucuccgucgaagggaaaagcugcauuaacagauguuuuuauguggagcucauccgcggacggaagcaggaaacggagguuugguggacauccaauucuauuguggucuucugcggcaccagcgggaccuacggcacaggauccuggccugauggcgccgacaucaaccugaugcccauuuga

SEQ ID NO: 198005 - RNA, 1410 nt, Artificial Sequence
  derived and/or modified sequence opt5 from neuraminidase__InfluenzaA__ABE14055
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucucuuccuggagcaaaaacauucuccgcacccaggaaucugagugcgucuguaucaaugggacaugcacgguggugaugaccgacggauccagcuccggcagagccgauacaaagauucuguuuaucgaggaagggaaaaucguccacauuucuccucuuagcggauccgcgcaacauguugaggaaugcagcuguuauccccgguacccuggcgugcgcugcguguguagagacaacuggaaggggucuaaccggcccaucgucgauauuaaugugaaggacuacuccaucguuagcucuuaugugugcagcggacuggucggcgacaccccgcgcaaaaacgauuccucuagcuccagcuacugucucaauccuaacaaugaggaaggcgggcacggagugaagggcugggccuucgacgaugggaacgacguuuggaugggaagaacaauuucugagaaacugcgguccggcuaugagaccuuuaaggugaucgggggauggagcaaacccaauucuaagcugcagaucaaccgccaggucauuguggauagaggcaaucgguccggcuacagcgggaucuucuccgucgaaggaaaaucuugcgugaacagauguuuuuauguugagcucauucgcggccggaagcaggaaacggaggugugguggacaagcaauuccaucgucguguucugcgggaccucuggaaccuacggcacagggagcuggccugacggcgcugauauuaaccugaugcccaucuga

SEQ ID NO: 198006 - RNA, 1410 nt, Artificial Sequence
  derived and/or modified sequence opt5 from neuraminidase__InfluenzaA__ABE14857
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaccacagaaaucguguaucucaccaacacgaccauugagaaggaaaucuguccuaaacuggccgaguaccggaauuggagcaagccccagugcaaaauuacaggguucgcgccuuuuuccaaggacaacucuauccgccuuagcgcuggaggcgauauuugggucaccagagagcccuauguguccugugacccugggaagugcuaccaauucgcccugggacagggcacaacccucaauaaccggcauucuaaugauacgguucacgaccgcacaccguauagaacccugcugaugaacgaacucggggugcccuuucaucugggaacaaaacaggucuguaucgccuggagcuccagcucuugccacgauggcaaggcuuggcuucauguguguguuaccggccacgacgagaaugccaccgcuuccuucaucuacgaugggcggcugguggacagcauuggaucuugguccaaaaacauccuccgcacacaggaaagcgagugcgucuguauuaauggcacgugcaccguggugaugacagaugggucugccuccggcagagcggacaccaagauccuguuuauugaggaaggaaaaaucguccacaucagcccucuuuccgggucugcccaacauguugaggaaugcagcuguuauccccgguacccuggagugcgcugcguguguagagauaacuggaagggcuccaaccggcccauugucgacaucaaugugaaggauuacagcauuguuucuuccuaugugugcagcggccuggucggggacacaccgcgcaaaaacgacucuagcuccucuagcuacugucucaauccuaacaaugaggaaggaggccacggggugaagggaugggcuuucgaugacggcaacgauguuuggauggggagaaccaucuccgagaaacugcggagcggauaugagacguuuaaggugauuggcggcuggucuaaacccaauuccaagcugcagaucaaccgccaggucaucguggacagagggaaucggagcggauacucuggcauuuucuccgucgaagggaaaagcugcaucaacagauguuuuuauguggagcucauucgcggacggaagcaggaaacagagguuugguggaccuccaauucuaucguggucuucugcggcaccagcgggacauacggcaccggauccuggccugauggcgccgacauuaaccugaugcccaucuga

SEQ ID NO: 198007 - RNA, 1410 nt, Artificial Sequence; identical to SEQ ID NO: 198004
  derived and/or modified sequence opt5 from neuraminidase__InfluenzaA__ABE15594

SEQ ID NO: 198008 - RNA, 1413 nt, Artificial Sequence
  derived and/or modified sequence opt5 from neuraminidase__InfluenzaA__ABE26994
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagagccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccgauaccggcaccgugaugugugucugcagagacaacuggcacuccucuaaucggccuugggugagcuuuaaccagaaucuggauuaucaaaucggguacauuugcuccggaguguucggcgacaacccccgcccuaaggauggggagggaagcuguaaucccgucacaguugacggcgccgacggcgugaaaggguuuucuuauagauacggaaacggcguguggaucgggcggacgaaguccaaucgccucagaaaaggauucgaaaugauuugggauccgaacggcuggaccgacacagauagcgacuuuucuaugaagcaggauaucgucgcgaugaccgacugguccggguauagcggcuccuucgugcagcacccugagcugacaggacuugauugcaugcggcccuguuuuuggguugaacuggugagaggccucccucgcgagaauaccacgaucuggacaucugggagcuccauuucuuucugcggagucaacagcgacaccgccaauugguccuggcccgauggcgcugaacugcccuucaccaucgacaaauga

SEQ ID NO: 198009 - RNA, 1350 nt, Artificial Sequence
  derived and/or modified sequence opt5 from neuraminidase__InfluenzaA__ABE97641
augaaccccaaucagaagaucauuaccaucggcagcauuugcauggugaucgggauuaucucccugaugcuccaaaucggaaacaugauuucuaucugggucagccacuccauucagacauggaaucagcaucaggccgagucuaucagcaacacgaauccucugaccgaaaaagcuguugccuccgugacacuugcgggcaacucuagccuguguccgauuagagggugggcugugcacuccaaggacaauagcauccggauuggaucuaaaggcgaugucuucgugauccgcgagcccuuuaucuccugcagccaucucgaauguagaaccuucuuucugacacaaggggcccuucugaacgacaagcacucuaauggaaccguuaaagaucgguccccucaucgcacacucaugagcugccccgugggcgaggccccuucucccuacaacuccagauucgaaagcgucgcuugguccgccucugcuugucacgacggcaccagcuggcugacgauugggaucuccggaccugauaauggcgccguggcgguucugaaguauaacgggauuaucaccgacacaauuaagagcuggcggaauaacauccuccgcacccaggagucugagugcgccugugugaauggauccugcuuuacagucaugaccgauggcccgagcaacgggcaggcuucuuacaaaaucuucaagauggaaaaaggaaagguggugaaaagcgucgagcuggacgcccccaacuaucacuacgaagaguguuccugcuauccugaugcuggcgagauuacguguguuugcagagacaauuggcauggcucuaaccggcccuggaucagcuuuaaucagaaccuugaauaccaaauuggguauaucugcuccggaguguucggcgauaauccucgccccaacgacgggacaggaagcuguggcccgaugucuccuaauggggccuacggagugaagggcuuuuccuucaaguacggcaacggggucuggauuggaagaaccaaaagcacaaauucucgguccggcuuugagaugaucugggaucccaacggguggaucggaaccgacagcuccuucucugugaagcaggacauuguugcgaucaccgauuggagcggcuauuccgggucuuuugugcagcacccugaacugacaggccucgacugcauucgccccuguuucugggucgagcugaucagaggacggcccaaagaaagcacgauuuggaccuccggcagcucuaucuccuucugcggggugaauagcgauauuguuucuugguccuggccugacggagccgagcuuccguuuacaaucgauaaguga

SEQ ID NO: 198010 - RNA, 1350 nt, Artificial Sequence
  derived and/or modified sequence opt5 from neuraminidase__InfluenzaA__ABE97642
augaaccccaaucagaagaucauuaccaucggcagcauuugcauggugaucgggauggucucccugaugcuccaaauuggaaacaugaucucuaucuggcugagccacuccauucagacaggcaaucagcaucaggccgagucuaucagcaacaauaaccuucugacggaaaaugcuguugccuccgugacccucgcggggaacucuagccuguguccuauuagaggaugggcugugcacuccaaagacaauagcauccggauuggcucuaagggggaugucuucgugauccgcgagccguuuauuuccugcagccaucuugaauguagaacauucuuucugacccaaggagcccuccugaacgacaaacacucuaauggcacaguuaaggaucggagcccccaucgcacccugaugagcugcccugugggcgaggcccccucuccuuacaacuccagauucgaaagcgucgcuugguccgccucugcuugucacgacgggaucagcuggcucacaaucggaauuuccggccccgauaauggggccguggcgguucugaaauauaacggaaucauuaccgacacgaucaagagcuggcggaauaacauucuucgcacccaggagucugagugcgccugugugaacggcuccugcuuuacagucaugaccgaugggccuagcaauggacaggcuucuuacaagaucuucaaaauggaaaagggcaaaguggugaaguccgucgagcuggacgccccgaacuaucacuacgaagaguguuccugcuaucccgaugcuggcgagaucacauguguuugcagagacaauuggcaugggucuaaccggccuugggugagcuuuaaucagaaccucgaauaccaaauuggauauaucugcuccggcguguucggggauaauccccgcccuaacgacggaaccggcagcugugggcccaugucuccgaauggagccuacggcgucaaaggcuuuuccuucaaguacgggaacggaguguggauuggcagaacgaaaagcacaaauucucgguccggguuugagaugaucugggauccuaacggauggaccggcacagacagcuccuucucuguuaagcaggacauuguggcgaucaccgauuggagcggguauuccggcucuuuuguccagcaccccgaacugaccggacuugacugcauccgcccuuguuucuggguggagcugauuagaggccggcccaaggaaagcacaaucuggacguccgggagcucuauuuccuucugcggaguuaauggcgauaccgugagcuggucuuggcccgacggggccgagcucccuuuuaucauugauaaauga

SEQ ID NO: 198011 - RNA, 1350 nt, Artificial Sequence
  derived and/or modified sequence opt5 from neuraminidase__InfluenzaA__ABE97644
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaccucuuggcugacgaucggaauuagcggcccugauaacggggccguugcggugcugaaguauaauggaaucauuaccgacacaaucaaguccuggcggaacaauauucuccgcacccaggagagcgagugcgccugugucaacggcucuugcuuuacagugaugaccgaugggccguccaacggacaggcuagcuacaaaaucuucaagauggaaaaaggcaagguggucaaaucuguugagcuggacgcccccaauuaucacuacgaagaguguagcugcuauccugaugcuggcgagaucacgugugugugcagagacaacuggcauggguccaaucggcccugggugucuuuuaaccagaaucuugaauaccaaauuggauauaucugcagcggcgucuucggggauaacccucgccccaaugacggaacaggcuccugugggccgaugagcccuaacggagccuacggcgugaagggcuuuucuuucaaguacgggaauggaguuuggauuggcagaaccaaauccacaaacagccggucuggguuugagaugaucugggaucccaauggauggaccggcaccgacuccagcuucuccgugaagcaggacauugucgcgcugacagauuggucuggguauagcggcuccuuugugcagcacccugaacucacgggacuggacugcauccgccccuguuucuggguugagcuuaucagaggccggcccaaagaaucuaccauuuggacaagcggguccagcaucucuuucugcggagugaacuccgauaccgucagcuggucuuggccugacggcgccgagcugccguuuacaauugauaaguga

SEQ ID NO: 198012 - RNA, 1350 nt, Artificial Sequence
  derived and/or modified sequence opt5 from neuraminidase__InfluenzaA__ABE97645
augaaccccaaucagaagaucauuaccaucggcagcauuugcauggugaucgggacagucucccugaugcuccaaauuggaaacaugaucucuaucuggguuagccacuccauucagacgggcaaucagcaucaggccgagccuaccucuagcacaaacccgcugaccgaaaaagcuguggccuccgugacacuugcgggaaauucuagccugugucccaucagagggugggcuauucacuccaaggacaacagcauccggauuggcucuaaaggggaugucuucgugauccgcgagccuuuuauuuccugcagccaucucgaauguagaaccuucuuucugacacaaggagcccuucugaaugacaagcacucuaacggcaccguuaaagaucggagcccccaucgcacgcucauguccugcccugugggcgaggcccccucuccuuacaauuccagauucgaaagcgucgcuugguccgccucugcuugucacgacgggaccagcuggcugacaaucggaaucuccggcccggauaacggggccguggcgguucugaaguauaauggaauuaucaccgacacaauuaagagcuggcggaacaauauccuccgcacccaggagucugagugcgccugugugaacggcuccugcuuuacggucaugacagaugggcccagcaauggacaggcuucuuacaaaauuuucaagauggaaaaaggcaagguggugaaaagcgucgagcuggacgccccuaacuaucacuacgaagaguguuccugcuaucccgaugcuggcgagaucaccuguguuugcagagacaacuggcaugggucuaaucggccuugggugagcuuuaaccagaaucuugaauaccaaaucggauauauuugcuccggcguguucggggauaacccccgcccgaaugacggaacaggcagcugugggccuaugucucccaacggagccuacggcgucaagggcuuugcguucaaguacgggaauggaguguggaucggcagaaccaaauccaccaacagccggucuggguuugagaugauuugggauccuaauggauggacaggccccgacuccagcuucuccguuaagcaggacaucguggccauuacggauuggucuggguauagcggcuccuuuguccagcaccccgaacugaccggacucgacugcauccgcccuuguuucuggguggagcugaucagaggccggccgaaagaaucuacaauuuggaccagcggguccagcaucucuuucugcggaguuaacuccgauacagugagcuggucuuggcccgacggcgcugagcuuccuuuuaccauugauaaguga

SEQ ID NO: 198013 - RNA, 1350 nt, Artificial Sequence
  derived and/or modified sequence opt5 from neuraminidase__InfluenzaA__ABE97646
augaaccccaaucagaagaucauuaccaucggcagcauuugcauggugaucgggauugucucccugaugcuccaaaucggaaacaugaucucuauuuggguuagccacuccauccagacagagaaucagcaucaggccgaaucuauuagcaacacgaauccuccgaccgagaaagcuguggccuccgugacacuggcgggcaacucuagccuuugucccaucagagggugggcuguccacuccaaggacaauagcauucggaucggaucuaaaggcgauguguucguuauucgcgaaccuuuuaucuccugcagccaucuggaguguagaaccuucuuucucacacaaggggcccugcuuaacgacaagcacucuaauggaaccgugaaagaucggucuccccaucgcacacugaugagcugcccugucggcgaagcccccucuccuuacaacuccagauucgagagcguggcuugguccgccucugcuugucacgacggcaccagcuggcucacgaucgggauuuccggaccggauaauggcgccguugcggugcugaaguauaacgggaucauuaccgacacaaucaagagcuggcggaauaacacccugcgcacacaggagucugaaugcgccugugucaauggauccugcuuuaccgugaugacggauggccccagcaacgggcaggcuucuuacaaaauuuucaagauggagaaaggaaagguggucaaaagcguugaacucgacgccccuaacuaucacuacgaggaguguuccugcuaucccgaugcuggcgaaaucacaugugugugcagagacaauuggcauggcucuaaccggccuugggugagcuuuaaucagaaccuggaguaccaaaucggguauauuugcuccggagucuucggcgauaauccccgcccgaacgacgggaccggaagcuguggcccuaugucucccaauggggccuacggagugaagggcuuuuccuucaaguacggcaacgggguuuggaucggaagaacaaaaagcaccaauucucgguccggcuuugaaaugauuugggauccuaacggguggaccggaacagacagcuccuucucugugaagcaggacaucgucagcauuacggauugguccggcuauucugggagcuuugugcagcaccccgagcuuaccggccuggacugcauccgccccuguuucuggguugaacucaucagaggacggccuaaagaguccacaauuuggaccagcggcuccuccaucagcuucugcggggucaauucugauacaguguccuggagcuggccggacggagcggagcugcccuuuaccauugauaaguga

SEQ ID NO: 198014 - RNA, 1350 nt, Artificial Sequence
  derived and/or modified sequence opt5 from neuraminidase__InfluenzaA__ABE97647
augaaccccaaucagaagaucauuaccaucggcagcauuugcauggugaucgggauugucucccugaugcuccaaaucggaaacaugaucucuauuuggguuagccacuccauccagacaggcaaucagcauagagccgagucuauuagcaacacgaauccucugaccgaaaaagcuguggccuccgugacacuugcggggaacucuagccuguguccgauccggggaugggcuguccacuccaaggacaauaacauucgcaucggcagcaaaggggauguguucguuauuagagagcccuuuaucucuugcucccaucucgaaugucggaccuucuuucugacacagggagcccuucugaaugacaagcacagcaacggcaccgugaaagaucgcucuccucauagaacacucauguccugccccgucggcgaggccccuagccccuacaauucucgguucgaauccguggcuuggagcgccuccgcuugucacgacgggaccucuuggcugacgaucggaauuagcggcccugauaacggggccguugcggugcugaaguauaauggaaucauuaccgacacaaucaaguccuggcgcaacaauauucucagaacccaagagagcgagugcgccugugucaacggcucuugcuuuacagugaugaccgaugggccguccaacggacaggcuagcuacaaaaucuucaagauggaaaaaggcaagguggucaaaucuguugagcuggacgcccccaauuaucacuacgaagaguguagcugcuauccugaugcuggcgagaucacgugugugugccgggacaacuggcauggguccaaucgccccugggugucuuuuaaccagaaucuugaauaccagauuggauauaucugcagcggcgucuucggggauaacccuagacccaaugacggaacaggcuccugugggccgaugagcccuaacggagccuacggcgugaagggcuuuucuuucaaguacgggaauggaguuuggauuggccggaccaaauccacaaacagccgcucuggguuugagaugaucugggaucccaauggauggaccggcaccgacuccagcuucuccgugaagcaagacauugucgcgaucacagauuggucuggguauagcggcuccuuugugcagcacccugaacugacgggacucgacugcaucagacccuguuucuggguugagcugauucggggccgccccaaagaaucuaccaucuggacaagcggguccagcauuucuuucugcggagugaacuccgauaccgucagcuggucuuggccugacggcgccgagcuuccguuuacaaucgauaaguga

SEQ ID NO: 198015 - RNA, 1350 nt, Artificial Sequence
  derived and/or modified sequence opt5 from neuraminidase__InfluenzaA__ABE97649
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauagcauucggaucggcucuaaaggggauguguucguuauucgcgagcccuuuaucuccugcagccaucucgaauguagaaccuucuuucugacacaaggagcccuucugaacgacaagcacucuaauggcaccgugaaagaucgguccccucaucgcacacucaugagcugccccgucggcgaggccccuucucccuacaacuccagauucgaaagcguggcuugguccgccucugcuugucacgacgggaccagcuggcugacgaucggaauuuccggcccugauaauggggccguugcggugcugaaguauaacggaaucauuaccgacacaaucaagagcuggcggaauaacauucuccgcacccaggagucugagugcgccugugucaauggcuccugcuuuacagugaugaccgaugggccgagcaacggacaggcuucuuacaaaaucuucaagauggaaaaaggcaagguggucaaaagcguugagcuggacgcccccaacuaucacuacgaagaguguuccugcuauccugaugcuggcgagaucacgugugugugcagagacaauuggcaugggucuaaccggcccugggugagcuuuaaucagaaccuugaauaccaaauuggauauaucugcuccggcgucuucggggauaauccucgccccaacgacggaacaggcagcugugggccgaugucuccuaauggagccuacggcgugaagggcuuuuccuucaaguacgggaacggaguuuggauuggcagaaccaaaagcacaaauucucgguccggguuugagaugaucugggaucccaacggauggaccggcaccgacagcuccuucucugugaagcaggacauugucgcgaucacagauuggagcggguauuccggcucuuuugugcagcacccugaacugacgggacucgacugcauccgccccuguuucuggguugagcugauuagaggccggcccaaagaaagcaccaucuggacauccgggagcucuauuuccuucugcggagugaauagcgauaccgucucuugguccuggccugacggcgccgagcuuccguuuacaaucgauaaguga

SEQ ID NO: 198016 - RNA, 1350 nt, Artificial Sequence; identical to SEQ ID NO: 198015
  derived and/or modified sequence opt5 from neuraminidase__InfluenzaA__ABE97651

SEQ ID NO: 198017 - RNA, 1350 nt, Artificial Sequence; identical to SEQ ID NO: 198015
  derived and/or modified sequence opt5 from neuraminidase__InfluenzaA__ABE97653

SEQ ID NO: 198018 - RNA, 1350 nt, Artificial Sequence; identical to SEQ ID NO: 198015
  derived and/or modified sequence opt5 from neuraminidase__InfluenzaA__ABE97654

SEQ ID NO: 198019 - RNA, 1350 nt, Artificial Sequence
  derived and/or modified sequence opt5 from neuraminidase__InfluenzaA__ABE97655
augaaccccaaucagaagaucauuaccaucggcagcauuugcauggccaucgggauugugucccugaugcuccaaaucggaaacaugaucucuauuugggucagccacuccauccagacaggcaaucagcaucaggcugagucuacgagcaacaccaauccucugacagaaaaagccguugcguccgugacccuugcugggaacucuagccuguguccgauuagaggaugggccauccacuccaaggacaauagcauucggaucggcucuaaaggggauguguucgucauucgcgagcccuuuaucuccugcagccaucucgaauguagaacauucuuucugacccaaggagcccuucugaacgacaagcacucuaauggcacagugaaagaucgguccccucaucgcacccucaugagcugccccguuggcgaggcuccuucucccuacaacuccagauucgaaagcguggccugguccgcuucugccugucacgacgggacgagcuggcugaccaucggaauuuccggcccugauaauggggcggucgccgugcugaaguauaacggaaucauuacagacaccaucaagagcuggcggaauaacauucuccgcacacaggagucugagugcgcuuguguuaauggcuccugcuuuaccgugaugacggaugggccgagcaacggacaggccucuuacaaaaucuucaagauggaaaaaggcaaggucgugaaaagcguggagcuggacgcucccaacuaucacuacgaagaguguuccugcuauccugaugccggcgagaucacaugugucugcagagacaauuggcaugggucuaaccggcccuggguuagcuuuaaucagaaccuugaauaccaaauuggauauaucugcuccggcguguucggggauaauccucgccccaacgacggaaccggcagcugugggccgaugucuccuaauggagcguacggcgugaagggcuuugccuucaaguacgggaacggagucuggauuggcagaacaaaauccaccaauagccggucuggguuugagaugaucugggaucccaacggauggaccggcccugacuccagcuucuccgugaagcaggacauuguugcuaucacagauuggucuggguauagcggcuccuuugugcagcaccccgaacugacgggacucgacugcauccgccccuguuucugggucgagcugauuagaggccggccuaaagaaucuaccaucuggacaagcggguccagcauuucuuucugcggaguuaauuccgauaccgugagcuggucuuggccggacggcgccgagcuucccuuuacaaucgauaaguga

SEQ ID NO: 198020 - RNA, 1350 nt, Artificial Sequence
  derived and/or modified sequence opt5 from neuraminidase__InfluenzaA__ABE97657
augaaccccaaucagaagaucauuaccaucggcagcauuugcauggugaucgggacagucucccugguucuccaaauuggaaacaugaucucuaucugggugagccacuccauucagacgggcaaucagcaucaggccgagucuaucagcaacaccaauccucugacagaaaaagcuguggccuccgucacccuugcggggaacucuagccuguguccgauuagaggaugggcugugcacuccaaggacaauagcauccggauuggcucuaaaggggauguuuucgugauccgcgagcccuuuauuuccugcagccaucucgaauguagaacauucuuucugacccaaggagcccuucugaacgacaagcacucuaauggcacagucaaagaucgguccccucaucgcacccucaugagcugccccgugggcgaggccccuucucccuacaacuccagauucgaaagcguugcuugguccgccucugcuugucacgacgggacgagcuggcugaccaucggaaucuccggcccugauaauggggccguggcgguccugaaguauaacggaauuaucacagacaccauuaagagcuggcgggauaauauccuccgcacacaggagucugagugcgccugugugaacggcuccugcuuuaccgugaugacggacgggccgagcaauggacaggcuucuuacaaaauuuucaagauggaaaaaggcaaggucguuaaaagcguggagcuggaugcccccaacuaucacuacgaagaguguuccugcuauccugacgcuggcgagaucacaugugugugcagagauaacuggcaugggucuaaucggcccugggucagcuuuaaccagaaucuugaauaccaaaucggauauauuugcuccggcguguucggggacaacccucgccccaaugauggaaccggcagcugugggccgaugucuuccaacggagccuacggcguuaagggcuuuagcuucaaguacgggaauggaguguggaucggcagaacaaaaucuaccaacucccggagcggguuugagaugauuugggacccuaauggauggaccggcacagacuccucuuucagcgucaagcaggauaucguggcgauuacggacugguccggguauucuggcagcuuuguucagcaccccgaacugaccggacucgauugcauccgcccuuguuucuggguggagcugaucagaggccggcccaaagaauccacaauuuggaccagcgggucuuccaucagcuucugcggagucaacucugacacaguguccuggagcuggcccgauggcgccgagcuuccuuuuaccauugacaaguga

SEQ ID NO: 198021 - RNA, 1350 nt, Artificial Sequence
  derived and/or modified sequence opt5 from neuraminidase__InfluenzaA__ABE97658
augaaccccaaucagaagaucauuaccaucggcagcauuugcauggugaucgggacaauuucccugaugcuccaaaucggaaacaugaucucuauuugggucagccacuccauccagacgggcaaucagcaucagaccgagucuauuagcaacacaaauccucugaccgaaaaagccguugcuuccgugacacuugccgggaacucuagccuguguuccaucagaggaugggcggugcacagcaaggacaauucuauucggaucggcuccaaaggggaugucuucgugauucgcgagccguuuaucagcugcucucaucucgaauguagaaccuucuuucugacacaaggagcccuucugaacgacaagcacuccaauggcaccguuaaagaucggagcccccaucgcacgcucaugucuugcccugugggcgaggcucccuccccuuacaacagcagauucgaauccgucgccuggucugcuagcgccugucacgacgggaccuccuggcugacaaucggaauuagcggccccgauaauggggcuguggccguucugaaguauaacggaaucauuaccgacacaaucaagucuuggcgggauaauauucuccgcacccaggaguccgagugcgcgugugugaacggcagcugcuuuacggucaugacagacgggccuucuaauggacaggccagcuacaaaaucuucaagauggaaaaaggcaagguggugaaauccgucgagcuggaugcuccgaacuaucacuacgaagaguguucuugcuaucccgacgccggcgagaucaccuguguuugcagagauaacuggcaugggagcaaucggccuuggguguccuuuaaccagaaucuugaauaccaaauuggauauaucugcagcggcguguucggggacaacccccgcccuaaugauggaacaggcucuugugggcccauguccagcaacggagcucacggcgucaagggcuuuucuuucaaguacgggaauggaguguggauuggcagaaccaaauccaccaacagccgguccggguuugagaugaucugggacccgaauggauggacaggcacggacucuagcuucuccguuaagcaggauauuguggccaucaccgacuggucuggguacagcggcuccuuuguccagcauccugaacugacaggacucgauugcauccgccccuguuucuggguggagcugauuagaggccggccuaaagaaagcaccaucuggacaucuggguccagcauuucuuucugcggaguuaacuccgacaccgugagcuggucuuggcccgauggcgcggagcuucccuuuacgaucgacaaguga

SEQ ID NO: 198022 - RNA, 1350 nt, Artificial Sequence
  derived and/or modified sequence opt5 from neuraminidase__InfluenzaA__ABE97659
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauagcauucggaucggcucuaaaggggauguguucguuauucgcgagcccuuuaucuccugcagccaucucgaauguagaaccuucuuucugacacaaggagcccuucugaacgacaagcacucuaaugagaccgugaaagaucgguccccucaucgcacacucaugagcugccccgucggcgaagccccuucucccuacaacuccagauucgagagcguggcuugguccgccucugcuugucacgacggcaccagcuggcugacgaucgggauuuccggaccugauaauggcgccguugcggugcugaaguauaacgggaucauuaccgacacaaucaagagcuggcgggauaauauucuccgcacccaggagucugaaugcgccugugucaacggauccugcuuuacagugaugaccgacggcccgagcaaugggcaggcuucuuacaaaaucuucaagauggagaaaggaaagguggucaaaagcguugaacuggaugcccccaacuaucacuacgaggaguguuccugcuauccugacgcuggcgaaaucacgugugugugcagagauaacuggcauggcucuaaucggcccugggugagcuuuaaccagaaucuugaguaccaaauuggguauaucugcuccggagucuucggcgacaacccucgccccaaugaugggacaggaagcuguggcccgaugucuuccaacggggccuacggagugaagggcuuuagcuucaaguacggcaaugggguuuggauuggaagaaccaaaucuacaaacucccggagcggcuuugaaaugaucugggacccuaauggguggaccggaaccgacuccucuuucagcgugaagcaggauauugucgcgaucacagacugguccggcuauucugggagcuuugugcagcaccccgagcugacgggccucgauugcauccgcccuuguuucuggguugaacugauuagaggacggcccaaagaguccaccaucuggacaagcgggucuuccauuagcuucugcggcgugaacucugacaccgucuccuggagcuggcccgauggagccgagcuuccuuuuacaaucgacaaguga

SEQ ID NO: 198023 - RNA, 1350 nt, Artificial Sequence
  derived and/or modified sequence opt5 from neuraminidase__InfluenzaA__ABE97660
augaaccccaaucagaagaucauuaccaucggcagcauuugcauggugaucgggacaauuucccugaugcuccaaaucggaaacaugaucucuauuugggucagccacuccauccagacgggcaaucagcaucaggccgagucuauuagcaacaccaauccucugacagaaaaagcuguugccuccgugacccuugcggggaacucuagccuguguccgaucagaggaugggcugugcacuccaaggacaauagcauucggaucggcucuaaaggggaugucuucgugauucgcgagcccuuuaucuccugcagccaucucgaauguagaacauucuuucugacccaaggagcccuucugaacgacaagcacucuaauggcacaguuaaagaucgguccccucaucgcacccucaugagcugccccgugggcgaggccccuucucccuacaacuccagauucgaaagcgucgcuugguccgccucugcuugucacgacgggacgagcuggcugaccaucggaauuuccggcccugauaauggggccguggcgguucugaaguauaacggaaucauuacagacaccaucaagagcuggcgggauaauauucuccgcacacaggagucugagugcgccugugugaacggcuccugcuuuaccgucaugacggacgggccgagcaauggacaggcuucuuacaaaaucuucaagauggaaaaaggcaagguggugaaaagcgucgagcuggaugcccccaacuaucacuacgaagaguguuccugcuauccugacgcuggcgagaucacauguguuugcagagauaacuggcaugggucuaaucggcccugggugagcuuuaaccagaaucuugaauaccaaauuggauauaucugcuccggcguguucggggacaacccucgccccaaugauggaaccggcagcugugggccgaugucuuccaacggagcccacggcgucaagggcuuuagcuucaaguacgggaauggaguguggauuggcagaacaaaaucuaccaacucccggagcggguuugagaugaucugggacccuaauggauggaccggcacagacuccucuuucagcguuaagcaggauauuguggcgaucacggacugguccggguacucuggcagcuuuguccagcaucccgaacugaccggacucgauugcauccgcccuuguuucuggguggagcugauuagaggccggcccaaagaauccacaaucuggaccagcgggucuuccauuagcuucugcggaguuaacucugacacaguguccuggagcuggcccgauggcgccgagcuuccuuuuaccaucgacaaguga

SEQ ID NO: 198024 - RNA, 1350 nt, Artificial Sequence
  derived and/or modified sequence opt5 from neuraminidase__InfluenzaA__ABE97661
augaaccccaaucagaagaucauuaccaucggcagcauuugcauggugaucgggacaauuucccugaugcuccaaaucggaaacaugaucucuauuugggucagccacuccauccagacgggcaaucagcaucagaccgagucuauuagcaacacaaauccucugaccgaaaaagccguugcuuccgugacacuugccgggaacucuagccuguguccgaucagaggaugggcggugcacuccaaggacaauagcauucggaucggcucuaaaggggaugucuucgugauucgcgagcccuuuaucuccugcagccaucucgaauguagaaccuucuuucugacacaaggagcccuucugaacgacaagcacucuaauggcaccguuaaagaucgguccccucaucgcacgcucaugagcugccccgugggcgaggcuccuucucccuacaacuccagauucgaaagcgucgccugguccgcuucugccugucacgacgggaccagcuggcugacaaucggaauuuccggcccugauaauggggcuguggccguucugaaguauaacggaaucauuaccgacacaaucaagagcuggcgggauaauauucuccgcacccaggagucugagugcgcgugugugaacggcuccugcuuuacggucaugacagacgggccgagcaauggacaggccucuuacaaaaucuucaagauggaaaaaggcaagguggugaaaagcgucgagcuggaugcucccaacuaucacuacgaagaguguuccugcuauccugacgccggcgagaucaccuguguuugcagagauaacuggcaugggucuaaucggcccugggugagcuuuaaccagaaucuugaauaccaaauuggauauaucugcuccggcguguucggggacaacccucgccccaaugauggaacaggcagcugugggccgaugucuuccaacggagcucacggcgucaagggcuuuagcuucaaguacgggaauggaguguggauuggcagaaccaaaucuaccaacucccggagcggguuugagaugaucugggacccuaauggauggacaggcacggacuccucuuucagcguuaagcaggauauuguggccaccacagacugguccggguacucuggcagcuuuguccagcaucccgaacugaccggacucgauugcauccgcccuuguuucuggguggagcugaucagaggccggcccaaagaauccacaguuuggaccagcgggucuuccauuagcuucugcggagugaacucugacacggucuccuggagcuggcccgauggcgcggagcuuccuuuuacaaucgacaaguga

SEQ ID NO: 198025 - RNA, 1350 nt, Artificial Sequence
  derived and/or modified sequence opt5 from neuraminidase__InfluenzaA__ABE97662
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauagcauucggaucggcucuaaaggggauguguucguuauucgcgagcccuuuaucuccugcagccaucucgaauguagaaccuucuuucugacacaaggagcccuucugaacgacaagcacucuaauggcaccgugaaagaucgguccccucaucgcacacucaugagcugccccgucggcgaggccccuucucccuacaacuccagauucgaaagcguggcuugguccgccucugcuugucacgacgggaccagcuggcugacgaucggaauuuccggcccugauaauggggccguugcggugcugaaguauaacggaaucauuaccgacacaaucaagagcuggcggaauaacauucuccgcacccaggagucugagugcgccugugucaauggcuccugcuuuacagugaugaccgaugggccgagcaacggacaggcuucuuacaaaaucuucaagaugagaaaaggcaagguggucaaaagcguugaacuggacgcccccaacuaucacuacgaggaauguuccugcuauccugaugcuggcgagaucacgugugugugccgggacaauuggcaugggucuaaccgccccugggugagcuuuaaucagaaccuugaguaccaaauuggauauaucugcuccggcgucuucggggauaauccuagacccaacgacggaacaggcagcugugggccgaugucuccuaauggagccuacggcgugaagggcuuuuccuucaaguacgggaacggaguuuggauuggccggaccaaaagcacaaauucucgcuccggguuugaaaugaucugggaucccaacggauggaccggcaccgacagcuccuucucugugaagcaggacauugucgcgaucacagauuggagcggguauuccggcucuuuugugcagcacccugagcugacgggacucgacugcaucagacccuguuucuggguugaacugauucggggccgccccaaagagagcaccaucuggacauccgggagcucuauuuccuucugcggagugaauagcgauaccgucucuugguccuggccugacggcgccgaacuuccguuuacaaucgauaaguga

SEQ ID NO: 198026 - RNA, 1350 nt, Artificial Sequence
  derived and/or modified sequence opt5 from neuraminidase__InfluenzaA__ABE97663
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcuguggccagcgugaaacuugcggggaacuccucucuguguccgauuaauggaugggcugucuacagcaaggacaacuccaucagaauuggcagcaagggggauguguuuguuauccgggagcccuucauuucuugcucccaucucgaaugucgcaccuuuuuccugacacagggagcccuucugaaugacaaacacagcaacggcaccgugaaggauagaucuccucaucggacacucauguccugccccgucggcgaggccccuagccccuauaauucucgcuuugaauccguggcuuggagcgccuccgcuugucacgacgggaccucuuggcugacgaucggaaucagcggcccugauaacggggccguugcggugcugaaguacaauggaauuaucaccgacacaauuaaauccuggagaaacaauauccuccggacccaagagagcgagugcgccugugucaacggcucuugcuucacagugaugaccgaugggccguccaacggacaggcuagccacaagauuuuuaaaauggaaaagggcaaaguggucaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuucgcuacgggaauggaguguggaucggcagaaccaaaagcacaaacucucgguccggguucgagaugauuugggauccuaauggauggaccgaaaccgacagcuccuuuucugucaagcaagacaucguggcgauuacagauuggagcggcuauuccgggucuuucguucagcaucccgagcugacgggccucgacugcauccgcccuuguuucuggguggaacugaucagaggacggcccaaagagagcaccauuuggacauccggcagcucuaucuccuuuugcggggucaacagcgauaccgugggauggucuuggcccgacggcgccgagcuuccuuucacaauugauaaguga

SEQ ID NO: 198027 - RNA, 1350 nt, Artificial Sequence
  derived and/or modified sequence opt5 from neuraminidase__InfluenzaA__ABE97665
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacacggagcccuucugaaugacaaacauagcaacggcaccgucaaggauagaucuccucaccggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaggagagcgagugcgccugugugaacggcucuugcuucacagugaugaccgaugggccguccaacggacaagcuagccauaagaucuuuaaaauggaaaagggcaaagucguuaagucuguggagcuggacgcccccaauuaucacuacgaagaguguagcugcuauccugaugcuggcgagauuacgugugugugccgcgacaacuggcauggguccaauagacccugggucucuuucaaccagaaucuugaauaccagaucggauauaucugcagcggcguguuuggggauaacccucggcccaaugacggaacaggcuccugugggccgguuagcucuaacggagccuacggcgugaagggcuucuccuuuaaauacgggaauggagucuggauuggccgcaccaagagcacaaacucuagauccggguucgagaugaucugggauccuaauggauggaccgaaaccgacagcuccuuuucugugaaacaggacauuguugcgaucacagauuggagcggcuauuccgggucuuucgugcaacaccccgagcugacgggccucgacugcauucggccuuguuucugggucgaacugauccgcggaagacccaaggagagcaccaucuggacauccggcagcucuauuuccuuuugcggggugaacagcgauaccgucggauggucuuggcccgacggcgccgagcuuccuuucacaaucgauaaauga

SEQ ID NO: 198028 - RNA, 1350 nt, Artificial Sequence
  derived and/or modified sequence opt5 from neuraminidase__InfluenzaA__ABE97666
augaaccccaaucagaagaucauuaccaucggcagcauuugcauggugacagggaucgucucccugaugcuccaaauuggaaacaugaucucuaucuggguuagccacuccauucauacgggcaaucagcaccagucugagccuaucagcaacaccaauuuccugacagaaaaagccguggcuuccgugaaacuugccgggaacucuccgcugugucccauuaauggaugggcggucuacagcaaggacaacuccaucagaauuggcagcaagggggauguguuuguuauccgggagccuuucauuucuugcucccaucucgaaugucgcaccuuuuuccugacacagggagcccuucugaaugacaaacacagcaacggcaccgugaaggauagaucuccccaucggacacucauguccugcccugucggcgaggcucccagcccuuauaauucucgcuuugaauccguggccuggagcgcuuccgccugucacgacgggaccucuuggcugacgaucggaaucagcggcccggauaacggggcuguugccgugcugaaguacaauggaauuaucaccgacacaauuaaauccuggagaaacaauauccuccggacccaagagagcgagugcgcgugugucaacggcucuugcuucacagugaugaccgaugggcccuccaacggacaggccagccacaagauuuuuaaaauggaaaagggcaaaguggucaagucuguugagcuggacgcuccuaauuaucauuacgaagaguguagcugcuaucccgaugccggcgagaucacgugugugugccgcgacaacuggcacggguccaauagaccuugggugucuuucaaccagaaucuugaauaccagaucggauauauuugcagcggcgucuuuggggauucuccccggccgaacgacggaacaggcagcugugggccugugucuuccaauggagcuuacggcguuaagggcuucagcuuuaaauacgggaacggaguguggaucggccgcaccaagucuacaaauuccagaagcggguucgagaugauuugggaucccaacggauggaccgaaaccgacuccucuuuuagcgucaaacaagacaucguggccauuacagauugguccggcuauucugggagcuucguucagcauccugagcugacgggccucgacugcauccggcccuguuucuggguggaacugauccgcggaagacccaaggaguccaccauuuggacaagcggcuccuccaucagcuuuugcggggucaauucugauaccgugggaugguccuggccugacggcgcggagcuuccguucacaauugauaaauga

SEQ ID NO: 198029 - RNA, 1350 nt, Artificial Sequence
  derived and/or modified sequence opt5 from neuraminidase__InfluenzaA__ABE97667
augaaccccaaucagaagaucauuaccaucggcagcauuugcauggugacagggaucgucucccugaugcuccaaauuggaaacaugaucucuaucuggggcagccacuccauucauacggggaaucagcaccagucugagccuaucagcaacaccaauuuccugacagaaaaagccguugcuuccgugaaacuugccggaaacucuagccuguguccgauuaauggcugggcgguguacuccaaggacaacagcaucagaauugggucuaagggagaugucuuugugauccgggagcccuucauuuccugcagccaucucgaaugucgcaccuuuuuccugacacagggcgcccuucugaaugacaaacacucuaacggcaccguuaaggauagauccccucaucggacacucaugagcugccccgugggggaggcuccuucucccuauaauucccgcuuugaaagcgucgccugguccgcuucugccugucacgacggaaccagcuggcugacgaucggcaucuccgggccugauaacggagcuguggccguugugaaguacaauggcauuaucaccgacacaauuaaaagcuggagaaacaauauccugcggacccaagagucugagugcgcgugugucaacggguccugcuucacagugaugaccgauggaccgagcaacggccaggccucucacaagauuuuuaaaauggaaaagggcaaaguggucaagagcguugagcucgacgcucccaauuaucauuacgaagaguguuccugcuauccugaugccgggaagaucacgugugugugccgcgacaacuggcacggaucuaauagacccugggugagcuucaaccagaaucuggaguaccagaucggcuauauuugcuccggggucuuuggagauaacccucggcccaaugacggcacagggagcuguggaccggugucuuccaacggcgcuuacggcguuaaaggguucagcuuuaaguacggaaauggcguguggaucgggcgcaccaaaucuacaaacuccagaagcggauucgaaaugauuugggauccuaauggcuggaccgagaccgacuccucuuuuagcgucaagcaagacaucguggccauuacagauugguccggguauucuggcagcuucguucagcaucccgaacuuacgggacuggacugcauccggccuuguuucuggguggagcucauccgcggcagacccaaagaauccaccauuuggacaagcgggucuuccaucagcuuuugcggagucaacucugauauugugggcugguccuggcccgacggggcggagcugccuuucaccaucgauaaguga

SEQ ID NO: 198030 - RNA, 1350 nt, Artificial Sequence
  derived and/or modified sequence opt5 from neuraminidase__InfluenzaA__ABE97669
augaaccccaaucagaagaucauuaccaucggcagcauuugcauggugacagggaucgucucccugaugcuccaaauuggaaacaugaucucuaucuggguuagccacuccauucauacgggcaaucagcaccagucugagccuaucagcaacaccaauuuccugacagaaaaagccguggcuuccgugaaacuugccgggaacucuagccuguguccgauuaauggaugggcggucuacuccaaggacaacagcaucagaauuggcucuaagggggauguguuuguuauccgggagcccuucauuuccugcagccaucucgaaugucgcaccuuuuuccugacacagggagcccuucugaaugacaaacacucuaacggcaccgugaaggauagauccccucaucggacacucaugagcugccccgucggcgaggcuccuucucccuauaauucccgcuuugaaagcguggccugguccgcuucugccugucacgacgggaccagcuggcugacgaucggaaucuccggcccugauaacggggcuguugccguggucaaguacaauggaauuaucaccgacacaauuaaaagcuggagaaacaauauccugcggacccaagagucugagugcgcgugugugaacggcuccugcuucacagugaugaccgaugggccgagcaacggacaggccucucacaagauuuuuaaaauggaaaagggcaaagucguuaagagcguggagcucgacgcucccaauuaucauuacgaagaguguuccugcuauccugaugccggcgagaucacgugugugugccgcgacaacuggcacgggucuaauagacccugggucagcuucaaccagaaucuggaauaccagaucggauauauuugcuccggcguguuuggggauaacccucggcccaaugacggaacaggcagcugugggccgguuucuuccaacggagcuuacggcgugaagggcuucagcuuuaaauacgggaauggagucuggaucggccgcaccaagucuacaaacuccagaagcggguucgagaugauuugggauccuaauggauggaccgaaaccgacuccucuuuuagcgugaaacaagacaucguugccauuacagauugguccggcuauucugggagcuucgugcagcaucccgagcuuacgggccuggacugcauccggccuuguuucugggucgaacucauccgcggaagacccaaggaguccaccauuuggacaagcgggucuuccaucagcuuuugcggcgugaacucugauaccgucggaugguccuggcccgacggcgcggagcugccuuucacaauugauaaauga

SEQ ID NO: 198031 - RNA, 1350 nt, Artificial Sequence
  derived and/or modified sequence opt5 from neuraminidase__InfluenzaA__ABE97670
augaaccccaaucagaagaucauuaccaucggcagcauuugcauggugacagggaucgucucccugaugcuccaaauuggaaacaugaucucuaucuggguuagccacuccauucauacgggcaaucagcaccagucugagccuaucagcaacaccaauuuccugacagaaaaagccguggcuuccgugaaacuugccgggaacucuagccuguguccgauuaauggaugggcggucuacuccaaggacaacagcaucagaauuggcucuaagggggauguguuuguuauccgggagcccuucauuuccugcagccaucucgaaugucgcaccuuuuuccugacacagggagcccuucugaaugacaaacacucuaacggcaccgugaaggauagauccccucaucggacacucaugagcugccccgucggcgaggcuccuucucccuauaauucccgcuuugaaagcguggccugguccgcuucugccugucacgacgggaccagcuggcugacgaucggaaucuccggcccugauaacggggcuguugccguggucaaguacaauggaauuaucaccgacacaauuaaaagcuggagaaacaauauccugcggacccaagagucugagugcgcgugugugaacggcuccugcuucacagugaugaccgaugggccgagcaacggacaggccucucacaagauuuuuaaaauggaaaagggcaaagucguuaagagcguggagcucgacacgcccaauuaucauuacgaagaguguuccugcuauccugaugcuggcgagaucacaugugugugccgcgacaacuggcacgggucuaauagacccugggucagcuucaaccagaaucuggaauaccagaucggauauauuugcuccggcguguuuggggauaacccucggcccaaugacggaaccggcagcugugggccgguuucuuccaacggagccuacggcgugaagggcuucagcuuuaaauacgggaauggagucuggaucggccgcacaaagucuaccaacuccagaagcggguucgagaugauuugggauccuaauggauggaccgaaacagacuccucuuuuagcgugaaacaagacaucguugcuauuacggauugguccggcuauucugggagcuucgugcagcaucccgagcuuaccggccuggacugcauccggccuuguuucugggucgaacucauccgcggaagacccaaggaguccacaauuuggaccagcgggucuuccaucagcuuuugcggcgugaacucugauacagucggaugguccuggcccgacggcgccgagcugccuuucaccauugauaaauga

SEQ ID NO: 198032 - RNA, 1350 nt, Artificial Sequence
  derived and/or modified sequence opt5 from neuraminidase__InfluenzaA__ABE97671
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcuguggccagcgugaaacuugcggggaacuccucucuguguccgauuaauggaugggcugucuacagcaaggacaacuccaucagaauuggcagcaagggggauguguuuguuauccgggagcccuucauuucuugcucccaucucgaaugucgcaccuuuuuccugacacagggagcccuucugaaugacaaacacagcaacggcaccgugaaggauagaucuccucaucggacacucauguccugccccgucggcgaggccccuagccccuauaauucucgcuuugaauccguggcuuggagcgccuccgcuugucacgacgggaccucuuggcugacgaucggaaucagcggcccugauaacggggccguugcggugcugaaguacaauggaauuaucaccgacacaauuaaauccuggagaaacaauauccuccggacccaagagagcgagugcgccugugucaacggcucuugcuucacagugaugaccgaugggccguccaacggacaggcuagccacaagauuuuuaaaauggaaaagggcaaaguggucaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuuaaauacgggaauggaguguggaucggccgcaccaagagcacaaacucuagauccggguucgagaugauuugggauccuaauggauggaccgaaaccgacagcuccuuuucugucaaacaagacaucguggcgauuacagauuggagcggcuauuccgggucuuucguucagcaucccgagcugacgggccucgacugcauccggccuuguuucuggguggaacugauccgcggaagacccaaggagagcaccauuuggacauccggcagcucuaucuccuuuugcggggucaacagcgauaccgugggauggucuuggcccgacggcgccgagcuuccuuucacaauugauaaauga

SEQ ID NO: 198033 - RNA, 1350 nt, Artificial Sequence
  derived and/or modified sequence opt5 from neuraminidase__InfluenzaA__ABE97672
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcucuugccagcgugaagcuggcggggaacuccucucucuguccgauuaauggaugggcuguguacagcaaagacaacuccaucagaauuggcagcaagggggaugucuuugugauccgggagcccuucauuucuugcucccaucuggaaugucgcaccuuuuuccuuacacagggagcccugcucaaugacaaacacagcaacggcaccguuaaggauagaucuccucaucggacacugauguccugccccgugggcgaggccccuagccccuauaauucucgcuuugaauccgucgcuuggagcgccuccgcuugucacgacgggaccucuuggcugacgaucggaaucagcggcccugauaacggggccguggcgguucucaaguacaauggaauuaucaccgacacaauuaaauccuggagaaacaauauccugcggacccaagagagcgagugcgccugugugaacggcucuugcuucacagucaugaccgaugggccguccaacggacaggcuagccacaagauuuuuaaaauggaaaagggcaaaguggugaagucugucgagcuugacgcccccaauuaucauuacgaagaguguagcugcuauccugaugcuggcgagaucacguguguuugccgcgacaacuggcacggguccaauagacccugggugucuuucaaccagaaucuggaauaccagaucggauauauuugcagcggcguguuuggggauaacccucggcccaaugacggaacaggcuccugugggccggucagcucuaacggagccuacggcgugaagggcuucuccuuuaaauacgggaauggaguuuggaucggccgcaccaagagcacaaacucuagauccggguucgagaugauuugggauccuaauggauggaccgaaaccgacagcuccuuuucugugaaacaagacaucgucgcgauuacagauuggagcggcuauuccgggucuuucgugcagcaucccgagcucacgggccuggacugcauccggccuuguuucuggguugaacuuauccgcggaagacccaaggagagcaccauuuggacauccggcagcucuaucuccuuuugcggggugaacagcgauaccgucggauggucuuggcccgacggcgccgagcugccuuucacaauugauaaauga

SEQ ID NO: 198034 - RNA, 1350 nt, Artificial Sequence
  derived and/or modified sequence opt5 from neuraminidase__InfluenzaA__ABE97675
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugaucgaaaaagcuguggccagcgucaaacuugcggggaacuccucucuguguccgauuaauggaugggcuguguacagcaaggacaacuccaucagaauuggcagcaagggggauguuuuugugauccgggagcccuucauuucuugcucccaucucgaaugucgcacauuuuuccugacccagggagcccuucugaaugacaaacacagcaacggcacagucaaggauagaucuccucaucggacccucauguccugccccgugggcgaggccccuagccccuauaauucucgcuuugaauccguugcuuggagcgccuccgcuugucacgacgggacaucuuggcugaccaucggaaucagcggcccugauaacggggccguggcgguccugaaguacaauggaauuaucacggacaccauuaaauccuggagaaacaauauccuccggacacaagagagcgagugcgccugugugaacggcucuugcuucaccgugaugacagaugggccguccaacggacaggcuagccacaagauuuuuaaaaucgaaaagggcaaagucguuaagucuguggagcuggacgcccccaauuaucauuacgaagaguguagcugcuauccugaugcuggcgagaucaccugugugugccgcgacaacuggcacggguccaauagacccugggucucuuucaaccagaaucuugaauaccagauuggauauaucugcagcggcguguuuggggauaacccucggcccaaugacggaacgggcuccugugggccgguuagcucuaacggagccuacggcgugaagggcuucuccuuuaaauacgggaauggagucuggauuggccgcacaaagagcaccaacucuagauccggguucgagaugaucugggauccuaauggauggagcgaaacagacuccucuuuuagcgugaaacaagacauuguugcgaucaccgauugguccggcuauucugggagcuucgugcagcaucccgagcugaccggccucgacugcauccggccuuguuucugggucgaacugauucgcggaagacccaaggaguccacaaucuggacgagcgggucuuccauuagcuuuugcggcgugaacucugauaccgucggaugguccuggcccgacggcgccgagcuuccuuucacaaucgauaaauga

SEQ ID NO: 198035 - RNA, 1350 nt, Artificial Sequence
  derived and/or modified sequence opt5 from neuraminidase__InfluenzaA__ABE97676
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcuguggccagcgugaaacuugcggggaacuccucucuguguccgauuaauggaugggcugucuacagcaaggacaacuccaucagaauuggcagcaagggggauguguuuguuauccgggagcccuucauuucuugcucccaucucgaaugucgcaccuuuuuccugacacagggagcccuucugaaugacaaacacagcaacggcaccgugaaggauagaucuccucaucggacacucauguccugccccgucggcgaggccccuagccccuauaauucucgcuuugaauccguggcuuggagcgccuccgcuugucacgacgggaccucuuggcugacgaucggaaucagcggcccugauaacggggccguugcggugcugaaguacaauggaauuaucaccgacacaauuaaauccuggagaaacaauauccuccggacccaagagagcgagugcgccugugucaacggcucuugcuucacagugaugaccgaugggccguccaacggacaggcuagccacaagauuuuuaaaauggaaaagggcaaaguggucaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuuaaauacgggaauggaguguggaucggccgcaccaagagcacaaacucuagauccggguucgagaugauuugggauccuaauggauggaccgaaaccgacagcuccuuuucugucaaacaagacaucguggcgauuaacgauuggagcggcuauuccgggucuuucguucagcaucccgagcugacaggccucgacugcauccggccuuguuucuggguggaacugauccgcggaagacccaaggagagcacgauuuggaccuccggcagcucuaucuccuuuugcggggucaauagcgauacagugggauggucuuggcccgacggcgccgagcuuccuuucaccauugauaaauga

SEQ ID NO: 198036 - RNA, 1350 nt, Artificial Sequence
  derived and/or modified sequence opt5 from neuraminidase__InfluenzaA__ABE97677
augaaccccaaucagaagaucauuaccaucggcagcauuugcauggugacagggaucgucucccugaugcuccaaauuggaaacaucaucucuauuuggguuagacacagcauccauacgggcaaucagcaccaguccgagccuauuucuaacaccaauuuccugacagaaaaagccguggcuagcgugaaacuugccgggaacuccucucuguguccgaucaauggaugggcggucuacagcaaggacaacuccauucggaucggcagcaagggggauguguuuguuauucgcgagcccuucaucucuugcucccaucucgaauguagaaccuuuuuccugacacagggagcccuucugaaugacaaacacagcaacggcaccgugaaggaucggucuccucaucgcacacucauguccugccccgucggcgaggcuccuagccccuauaauucuagauuugaauccguggccuggagcgcuuccgccugucacgacgggaccucuuggcugacgaucggaauuagcggcccugauaacggggcuguugccguggucaaguacaauggaaucauuaccgacacaaucaaauccuggcggaacaauauucugcgcacccaagagagcgagugcgcgugugugaacggcucuugcuucacagugaugaccgaugggccguccaacggacaggccagccacaagaucuuuaaaauggaaaagggcaaagucguuaagucuguggagcucgacgcucccaauuaucauuacgaagaguguagcugcuauccugaugccggcgagaucacgugugugugcagagacaacuggcacggguccaaucggcccugggucucuuucaaccagaaucuggaauaccagauuggauauaucugcagcggcguguuuggggauaacccucgccccaaugacggaacaggcuccugugggccgguuagcucuaacggagcuuacggcgugaagggcuucuccuuuaaauacgggaauggagucuggauuggcagaaccaagagcacaaacucucgguccggguucgagaugaucugggauccuaauggauggaccgaaaccgacagcuccuuuucugugaaacaagacauuguugccaucacagauuggagcggcuauuccgggucuuucgugcagcaucccgagcuuacgggccuggacugcauccgcccuuguuucugggucgaacucauuagaggacggcccaaggagagcaccaucuggacauccggcagcucuauuuccuuuugcggggugaacagcgauaccgucggauggucuuggcccgacggcgcggagcugccuuucacaaucgauaaauga

SEQ ID NO: 198037 - RNA, 1350 nt, Artificial Sequence
  derived and/or modified sequence opt5 from neuraminidase__InfluenzaA__ABE97679
augaaccccaaucagaagaucauuaccaucggcagcauuugcauggugacagggaucgucucccugaugcuccaaauuggaaacaugaucucuaucuggguuagacacagcauucauacgggcaaucagcaccaguccgagccuaucucuaacaccaauuuccugacagaaaaagccguggcuagcgugaaacuugccgggaacuccucucuguguccgauuaauggaugggcggucuacagcaaggacaacuccauccggauuggcagcaagggggauguguuuguuauccgcgagcccuucauuucuugcucccaucucgaauguagaaccuuuuuccugacacagggagcccuucugaaugacaaacacagcaacggcaccgugaaggaucggucuccucaucgcacacucauguccugccccgucggcgaggcuccuagccccuauaauucuagauuugaauccguggccuggagcgcuuccgccugucacgacgggaccucuuggcugacgaucggaaucagcggcccugauaacggggcuguugccguggucaaguacaauggaauuaucaccgacacaauuaaauccuggcggaacaauauccugcgcacccaagagagcgagugcgcgugugugaacggcucuugcuucacagugaugaccgaugggccguccaacggacaggccagccacaagauuuuuaaaauggaaaagggcaaagucguuaagucuguggagcucgacgcucccaauuaucauuacgaagaguguagcugcuauccugaugccggcgagaucacgugugugugcagagacaacuggcacggguccaaucggcccugggucucuuucaaccagaaucuggaauaccagaucggauauauuugcagcggcguguuuggggauaacccucgccccaaugacggaacaggcuccugugggccgguuagcucuaacggagcuuacggcgugaagggcuucuccuuuaaauacgggaauggagucuggaucggcagaaccaagagcacaaacucucgguccggguucgagaugauuugggauccuaauggauggaccgaaaccgacagcuccuuuucugugaaacaagacaucguugccauuacagauuggagcggcuauuccgggucuuucgugcagcaucccgagcuuacgggccuggacugcauccgcccuuguuucugggucgaacucaucagaggacggcccaaggagagcaccauuuggacauccggcagcucuaucuccuuuugcggggugaacagcgauaccgucggauggucuuggcccgacggcgcggagcugccuuucacaauugauaaauga

SEQ ID NO: 198038 - RNA, 1350 nt, Artificial Sequence; identical to SEQ ID NO: 198030
  derived and/or modified sequence opt5 from neuraminidase__InfluenzaA__ABE97680

SEQ ID NO: 198039 - RNA, 1350 nt, Artificial Sequence; identical to SEQ ID NO: 198030
  derived and/or modified sequence opt5 from neuraminidase__InfluenzaA__ABE97681

SEQ ID NO: 198040 - RNA, 1350 nt, Artificial Sequence; identical to SEQ ID NO: 198030
  derived and/or modified sequence opt5 from neuraminidase__InfluenzaA__ABE97682

SEQ ID NO: 198041 - RNA, 1350 nt, Artificial Sequence
  derived and/or modified sequence opt5 from neuraminidase__InfluenzaA__ABE97684
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcuguggccagcgugaaacuugcggggaacuccucucuguguccgauuaauggaugggcugucuacagcaaggacaacuccaucagaauuggcagcaagggggauguguuuguuauccgggagcccuucauuucuugcucccaucucgaaugucgcaccuuuuuccugacacagggagcccuucugaaugacaaacacagcaacggcaccgugaaggauagaucuccucaucggacacucauguccugccccgucggcgaggccccuagccccuauaauucucgcuuugaauccguggcuuggagcgccuccgcuugucacgacgggaccucuuggcugacgaucggaaucagcggcccugauaacggggccguugcggugcugaaguacaauggaauuaucaccgacacaauuaaauccuggagaaacaauauccuccggacccaagagagcgagugcgccugugucaacggcucuugcuucacagugaugaccgaugggccguccaacggacaggcuagccacaagauuuuuaaaauggaaaagggcaaaguggucaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuuaaauacgggaauggaguguggaucggccgcaccaagagcacaaacucuagauccggguucgagaugauuugggauccuaauggauggaccgaaaccgacagcuccuuuucugucaaacaagacaucguggcgauuacagauuggagcggcuauuccgggucuuucguucagcaucccgagcugacgggccucgacugcauccggccuuguuucuggguggaacugauccgcggaagacccaaggagagcaccauuuggacauccggcagcucuaucuccuuuugcggggucaacagcggaaccgugggcuggucuuggcccgauggggccgagcuuccuuucacaauugacaaauga

SEQ ID NO: 198042 - RNA, 1350 nt, Artificial Sequence
  derived and/or modified sequence opt5 from neuraminidase__InfluenzaA__ABE97685
augaaccccaaucagaagaucauuaccaucggcagcauuugcauggugacagggaucgucucccugaugcuccaaauuggaaacaugaucucuaucuggguuagccacuccauucauacgggcaaucagcaccaggccgagccuaucucuaacaccaauuuccugacagaaaaagcuguggccagcgugaaacuugcggggaacuccucucuguguccgauuaauggaugggcugucuacagcaaggacaacuccaucagaauuggcagcaagggggauguguuuguuauccgggagcccuucauuucuugcucccaucucgaaugucgcaccuuuuuccugacacagggagcccuucugaaugacaaacacagcaacggcaccgugaaggauagaucuccucaucggacacucauguccugccccgucggcgaggccccuagccccuauaauucucgcuuugaauccguggcuuggagcgccuccgcuugucacgacgggaccucuuggcugacgaucggaaucagcggcccugauaacggggccguugcggugcugaaguacaauggaauuaucaccgacacaauuaaauccuggagaaacaauauccuccggacccaagagagcgagugcgccugugucaacggcucuugcuucacagugaugaccgaugggccguccaacggacaggcuagccacaagauuuuuaaaauggaaaagggcaaaguggucaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuuaaauacgggaauggaguguggaucggccgcaccaagagcacaaacucuagauccggguucgagaugauuugggauccuaauggauggaccgaaaccgacagcuccuuuucugucaaacaagacaucguggcgauuacagauuggagcggcuauuccgggucuuucguucagcaucccgagcugacgggccucgacugcauccggccuuguuucuggguggaacugauccgcggaagacccaaggagagcaccauuuggacauccggcagcucuaucuccuuuugcggggucaacagcgauaccggaggcuggucuuggcccgacggggccgagcuuccuuucacaauugauaaauga

SEQ ID NO: 198043 - RNA, 1350 nt, Artificial Sequence; identical to SEQ ID NO: 198032
  derived and/or modified sequence opt5 from neuraminidase__InfluenzaA__ABE97686

SEQ ID NO: 198044 - RNA, 1350 nt, Artificial Sequence
  derived and/or modified sequence opt5 from neuraminidase__InfluenzaA__ABE97687
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaauggaaaagggcaaagucguuaagucuguggagcuggacgcccccaauuaucauuacgaagaguguagcugcuauccugaugcuggcgagauuacgugugugugccgcgacaacuggcacggguccaauagacccugggucucuuucaaccagaaucuugaauaccagaucggauauaucugcagcggcguguuuggggauaacccucggcccaaugacggaacaggcuccugugggccgguuagcucuaacggagccuacggcgugaagggcuucuccuuuaaauacgggaauggagucuggauuggccgcaccaagagcacaaacucuagauccggguucgagaugaucugggauccuaauggauggaccgaaaccgacagcuccuuuucugugaaacaagacauuguugcgaucacagauuggagcggcuauuccgggucuuucgugcagcaucccgagcugacgggccucgacugcauucggccuuguuucugggucgaacugauccgcggaagacccaaggagagcaccaucuggacauccggcagcucuauuuccuuuugcggggugaacagcgauaccgucggauggucuuggcccgacggcgccgagcuuccuuucacaaucgauaaauga

SEQ ID NO: 198045 - RNA, 1350 nt, Artificial Sequence
  derived and/or modified sequence opt5 from neuraminidase__InfluenzaA__ABE97688
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaauggaaaagggcaaagucauuaagucuguugagcuggacgcccccaauuaucauuacgaagaguguagcugcuauccugaugcuggcgagaucacgugugugugccgcgacaacuggcacggguccaauagacccugggugucuuucaaccagaaucuugaauaccagaucggauauauuugcagcggcgucuuuggggauaacccucggcccaaugacggaacaggcuccugugggccggugagcucuaacggagccuacggcguuaagggcuucuccuuuaaauacgggaauggagugugggucggccgcaccaagagcacaaacucuagauccggguucgagaugaucugggauccuaauggauggaccgaaaccgacagcuccuuuucugugaaacaagacauuguugcgaucacagauuggagcggcuauuccgggucuuucgugcagcaucccgagcugacgggccucgacugcauucggccuuguuucugggucgaacugauccgcggaagacccaaggagagcaccaucuggacauccggcagcucuauuuccuuuugcggggugaacagcgauaccgucggauggucuuggcccgacggcgccgagcuuccuuucaucauugauaaauga

SEQ ID NO: 198046 - RNA, 1350 nt, Artificial Sequence
  derived and/or modified sequence opt5 from neuraminidase__InfluenzaA__ABE97690
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggucccucaugagcugccccgugggcgaggccccuucucccuauaauucccgcuuugaaagcguugcuugguccgccucugcuugucacgacgggacaagcuggcugaccauuggaaucuccggcccugauaacggggccguggcgguccugaaguacaauggaaucauuacggacaccaucaaaagcuggagaaacaauauucuccggacacaagagucugagugcgccugugugaacggcuccugcuucaccgugaugacagaugggccgagcaacggacaggcuucucacaagaucuuuaaaaugaagaaaggcaaggucguuaagagcguggaacuggacgcccccaauuaucauuacgaggaauguuccugcuauccugaugcuggcgagauuaccugugugugccgcgacaacuggcacgggucuaauagacccugggucagcuucaaccagaaucuugaguaccagaucggauauaucugcuccggcguguuuggggauaacccucggcccaaugacggaacgggcagcugugggccgguuucuuccaacggagccuacggcgugaaaggcuucagcuuuaaguacgggaauggagucuggauuggccgcacaaaaucuaccaacuccagaagcggguucgaaaugaucugggauccuaauggauggacagagaccgacuccucuuuuagcgugaagcaagacauuguugcgaucaccgauugguccggcuauucugggagcuucgugcagcaucccgaacugacaggccucgacugcauucggccuuguuucugggucgagcugauccgcggaagacccaaagaauccacgaucuggaccagcgggucuuccauuagcuuuugcggcgugaacucugauacagucggaugguccuggcccgacggcgccgagcuuccuuucaccaucgauaaguga

SEQ ID NO: 198047 - RNA, 1350 nt, Artificial Sequence
  derived and/or modified sequence opt5 from neuraminidase__InfluenzaA__ABE97691
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugaaacgggagcccugcauuucuuguucccaucucaagugccgcaccuucuuucugacacagggagcccuucugaaugacaagcacagcaacggcaccgucaaagauagaucuccucaucggacacucauguccugucccgugggcgaagccccuagccccuauaauucucgcuucgaguccguugcuuggagcgccuccgcuugccacgacgggaccucuuggcugacgaucggaauuagcggcccugauaacggggccguggcgguccugaaguacaauggaaucaucaccgacacaauuaaauccuggagaaacaauauccuccggacccaagaaagcgagugugccugcgugaacggcucuuguuuuacagugaugaccgaugggccguccaacggacaggcuagccacaagauuuucaaaauggagaagggcaaggucguuaaaucuguggaacuggacgcccccaauuaucauuacgaggaaugcagcuguuauccugaugcuggcgagaucacgugcgugugccgcgacaacuggcacggguccaauagacccugggucucuuuuaaccagaaucuugaguaccagauuggauauaucuguagcggcguguucggggauaacccucggcccaaugacggaacaggcuccugcgggccgguuagcucuaacggagccuacggcgugaagggcuuuuccuucaaauacgggaauggagucuggaucggccgcaccaagagcacaaacucuagauccggguuugaaaugauuugggauccuaauggauggaccgagaccgacagcuccuucucugugaaacaagacaucguugcgauuacagauuggagcggcuauuccgggucuuuugugcagcaucccgaacugacgggccucgacuguauccggccuugcuucugggucgagcugauucgcggaagacccaaggaaagcaccaucuggacauccggcagcucuaucuccuucuguggggugaacagcgauaccgucggauggucuuggcccgacggcgccgagcuuccuuuuacaauugauaaauga

SEQ ID NO: 198048 - RNA, 1350 nt, Artificial Sequence
  derived and/or modified sequence opt5 from neuraminidase__InfluenzaA__ABE97694
augaaccccaaucagaagaucaugaccauuggcagcaucugcauggugacagggauugucucccugaugcuccaaguuggaaacaugaucucuauuugggugagccacuccauccauacgggcaaucagcaccaggccgagccuaucucuaacaccaauuuccugacagaaaaagcuguggacagcgucaaacuugccgggaacuccucucuguguccgauuaauggaugggcgguguacagcaaggauaacuccaucagaauuggcagcaagggggacguuuuugugauccgggagcccucugucuccugcagccaucucgaaugucgcaccuucuuucugacacagggagcccuucugaaugauaaacacucuaacggcaccgugaaggacagauccccucaucggacacucaugagcugccccguuggcgaggcuccuucucccuauaauucccgcuucgaaagcguggccugguccgcuucugccugucacgaugggaccagcuggcugacgauuggaaucuccggcccugacaacggggcugucgccgugcugaaguacaauggaauuaucaccgauacaaucaaaagcuggagaaacaauauucuccggacccaagagucugagugcgcgugugugaacggcuccugcuuuacagucaugaccgacgggccgagcaacggacaggccucucacaagaucuucaaaauggaaaagggcaaaguugugaagucuguggagcuggaugcucccaauuaucauuacgaagaguguuccugcuauccugacgccggcgagauuacgugugucugccgcgauaacuggcacgggucuaauagacccugggugagcuuuaaccagaaucuugaauaccagaucggauauauuugcuccggcguuuucggggacaacccucggcccaaugauggaacaggcagcugugggccggugucuuccaacggagcuuacggcgucaagggcuuuagcuucaaauacgggaauggaguguggaucggccgcaccaagucuacaaacuccagaagcggguuugagaugaucugggacccuaauggauggaccgaaaccgacuccucuuucagcguuaaacaagauguggucgccauuacagacugguccggcuauucugggagcuuugugcagcaucccgagcugacgggccucgauugcauccggccuuguuucugggucgaacugauucgcggaagacccaaggaguccaccaucuggacaagcggcagcuccauuagcuucugcggggugaacucugacaccguuggaugguccuggcccgauggcgcggagcuuccuuuuacaaucgacaaauga

SEQ ID NO: 198049 - RNA, 1350 nt, Artificial Sequence
  derived and/or modified sequence opt5 from neuraminidase__InfluenzaA__ABE97696
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcucugucaaggauagauccccucaucggacccucaugagcugcucugugggcgaggcccccuccccuuauaauagccgcuuugaauccguugcuuggucugccagcgcuugucacgacgggacauccuggcugaccauuggaaucagcggccccgauaacggggccguggcgguccugaaguacaauggaaucauuacggacaccaucaaaucuuggagaaacaauauucuccggacacaagaguccgagugcgccugugugaacggcagcugcuucaccgugaugacagaugggccuucuaacggacaggcuagccacaagaucuuuaaaauggaaaagggcaaagucguuaaguccguggagcuggacgccccgaauuaucauuacgaagaguguucuugcuaucccgaugcuggcgagauuaccugugugugccgcgacaacuggcacgggagcaauagaccuugggucuccuucaaccagaaucuugaauaccagaucggauauaucugcagcggcguguuuggggauaacccccggccuaaugacggaacgggcucuugugggcccguuuccagcaacggagccuacggcgugaagggcuucucuuuuaaauacgggaauggagucuggauuggccgcacaaaguccaccaacagcagauccggguucgagaugaucugggauccgaauggauggacagaaaccgacucuagcuuuuccgugaaacaagacauuguugcgaucaccgauuggucuggcuauagcggguccuucgugcagcauccugagcugacaggccucgacugcauucggcccuguuucugggucgaacugauccgcggaagaccuaaggagagcacgaucuggaccucuggcuccagcauuucuuuuugcggggugaacuccgauacagucggauggagcuggcccgacggcgccgagcuucccuucaccaucgauaaauga

SEQ ID NO: 198050 - RNA, 1350 nt, Artificial Sequence
  derived and/or modified sequence opt5 from neuraminidase__InfluenzaA__ABE97697
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugaacgaaaaagcuguggccagcgucaaacuugcgggaaauuccucucuguguccgaucaacgggugggcuguguacagcaaggacaauuccauuagaaucggcagcaagggggauguuuuugugauucgggagcccuucaucucuugcucccaucucgaaugucgcacauuuuuccugacccagggagcccuucugaacgacaaacacagcaauggcacagucaaggauagaucuccucaucggacccucauguccugccccgugggcgaggccccuagccccuauaacucucgcuuugaauccguugcuuggagcgccuccgcuugucacgacgggacaucuuggcugaccauuggaaucagcggcccugauaauggggccguggcgguccugaaguacaacggaaucauuacggacaccaucaaauccuggagaaauaacauucuccggacacaagagagcgagugcgccugugugaacggcucuugcuucaccgugaugacagaugggccguccaauggacaggcuagccacaagaucuuuaaaauggaaaagggcaaagucguuaagucuguggagcuggacgcccccaacuaucauuacgaagaguguagcugcuauccugaugcuggcgagauuaccugugugugccgcgacaauuggcacggguccaacagacccugggucucuuucaaucagaaccuugaauaccagaucggauauaucugcagcggcguguuuggggauaauccucggcccaacgacgagacgggauccuguggcccgguuagcucuaauggggccuacggagugaagggcuucuccuuuaaauacggcaacggggucuggauuggacgcacaaagagcaccaauucuagauccggcuucgaaaugaucugggauccuaacggguggacagagaccgacagcuccuuuucugugaaacaagacauuguugcgaucaccgauuggagcggauauuccggcucuuucgugcagcaucccgaacugacagggcucgacugcauucggccuuguuucugggucgagcugauccgcggcagacccaaggagagcacgaucuggaccuccggaagcucuauuuccuuuugcggcgugaauagcgauacagucggguggucuuggcccgacggagccgaacuuccuuucaccaucgauaaauga

SEQ ID NO: 198051 - RNA, 1350 nt, Artificial Sequence
  derived and/or modified sequence opt5 from neuraminidase__InfluenzaA__ABE97702
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaauggaaaagggcaaagucguuaagucuguggagcuggacgcccccuauuaccauuaugaagaguguagcugcuacccugaugcuggcgagauuacgugugugugccgcgacaauuggcacggguccaacagacccugggucucuuucaaucagaaccuugaauaucagaucggauacaucugcagcggcguguuuggggauaauccucggcccaacgacggaacaggcuccugugggccgguuagcucuaauggagccuacggcgugaagggcuucuccuuuaaauaugggaacggagucuggauuggccgcaccaagagcacaaauucuagauccggguucgagaugaucugggauccuaacggauggaccgaaaccgacagcuccuuuucugugaaacaagacauuguuagcaucacagauugguccggcuacucugggagcuucgugcagcaucccgagcugacgggccucgacugcauucggccuuguuucugggucgaacugauccgcggaagacccaaggaguccaccaucuggacaagcgggucuuccauuagcuuuugcggcgucaauucugauaccgugggaugguccuggcccgacggcgcggagcuuccuuucacaaccgauaaauga

SEQ ID NO: 198052 - RNA, 1350 nt, Artificial Sequence; identical to SEQ ID NO: 198044
  derived and/or modified sequence opt5 from neuraminidase__InfluenzaA__ABE97703

SEQ ID NO: 198053 - RNA, 1350 nt, Artificial Sequence; identical to SEQ ID NO: 198044
  derived and/or modified sequence opt5 from neuraminidase__InfluenzaA__ABE97705

SEQ ID NO: 198054 - RNA, 1350 nt, Artificial Sequence
  derived and/or modified sequence opt5 from neuraminidase__InfluenzaA__ABE97706
augaaccccaaucagaagaucauuaccaucggcagcauuugcauggugacagggaucgucucccugaugcuccaaguuggaaacaugauuucucugugggugagccacuccauccauacgggcaaucagcaccaggccgagccuaucucuaacaccaauuuccuuacagaaagagcuguggccagcgucaaacuggcggggaacuccucucucuguccgauuaauggaugggcuguguacagcaaggacaacuccauccggauuggcagcaaaggggauguuuuugugauccgcgagcccuucauuucuugcucccaucuggaauguagaaccuuuuuccuuacacagggagcccugcucaaugacaagcacagcaacggcaccgucaaagaucggucuccucaucgcacacugauguccugccccgugggcgaggccccuagccccuauaauucuagauuugaauccguugcuuggagcgccuccgcuugucacgacgggaccucuuggcugacgaucggaauuagcggcccugauaacggggccguggcgguccucaaguacaauggaaucaucaccgacacaauuaaguccuggcggaacaauauccugcgcacccaagagagcgagugcgccugugugaacggcucuugcuucacagugaugaccgaugggccguccaacggacaggcuagccacaaaauuuuuaagauggaaaaaggcaaggucguuaaaucuguggagcuugacgcccccaauuaucauuacgaagaguguagcugcuauccugaugcuggcgagaucacgugugugugcagagacaacuggcacggguccaaucggcccugggucucuuucaaccagaaucuggaauaccagauuggauauaucugcagcggcguguuuggggauaacccucgccccaaugacggaacaggcuccugugggccgguuagcucuaacggagccuacggcgugaagggcuucuccuuuaaguacgggaauggagucuggaucggcagaaccaaaagcacaucuucccggagcggguucgagaugauuugggauccuaacggauggaccgaaaccgacuccucuuuuagcgugaagcaagacaucguugcgauuacagauugguccggcuauucugggagcuucgugcagcaucccgagcucacgggccuggacugcauccgcccuuguuucugggucgaacuuauuagaggacggcccaaagaguccaccaucugggccagcgggucuuccaucagcuuuugcggcgucaauucugauacagugggaugguccuggcccgacggcgcugagcugccuuucaccauugauaaguga

SEQ ID NO: 198055 - RNA, 1350 nt, Artificial Sequence
  derived and/or modified sequence opt5 from neuraminidase__InfluenzaA__ABE97707
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaagggaugggcuguguacagcaaggacaauuccauuagaaucggcagcaaaggggauguuuuugugauucgggagcccuucaucucuugcucccaucucgaaugucgcaccuuuuuccugacacagggagcccuucugaacgacaagcacagcaauggcaccgucaaggauagaucuccucaucggacacucauguccugccccgugggcgaggccccuagccccuauaacucucgcuuugaauccguugcuuggagcgccuccgcuugucacgacgggaccucuuggcugacgauuggaaucagcggcccugauaauggggccguggcgguccugaaauacaacggaaucauuaccgacacaaucaaguccuggagaaauaacauucuccggacccaagagagcgagugcgccugugugaauggcucuugcuucacagugaugaccgaugggccguccaacggacaggcuagccacaaaaucuuuaagauggaaaaaggcaaggucguuaagucuguggagcuggacgcccccaacuaucauuacgaagaguguagcugcuauccugaugcuggcgagauuacgugugugugccgcgacaauuggcacggguccaacagacccugggucucuuucaaucagaaccuugaauaccagaucggauauaucugcagcggcguguuuggggauaauccucggcccaacgacggaacaggcuccugugggccgguuagcucuaauggagccuacggcgugaaaggcuucuccuuuaaguacgggaacggagucuggauuggccgcaccaaaagcacaaauucuagauccggguucgagaugaucugggauccuaacggauggaccgaaaccgacagcuccuuuucugugaagcaagacauuguugcgaucacagauuggagcggcuauuccgggucuuucgugcagcaucccgagcugacgggccucgacugcauucggccuuguuucugggucgaacugauccgcggaagacccaaagagagcaccaucuggacauccggcagcucuauuuccuuuugcggggugaauagcgauaccgucggauggucuuggcccgacggcgccgagcuuccuuucacaaucgauaaguga

SEQ ID NO: 198056 - RNA, 1350 nt, Artificial Sequence
  derived and/or modified sequence opt5 from neuraminidase__InfluenzaA__ABE97708
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacacggagcccuucugaaugacaaacauagcaacggcaccgucaaggauagaucuccucaccggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaggagagcgagugcgccugugugaacggcucuugcuucacagugaugaccgaugggccguccaacggacaagcuagccauaagaucuuuaaaaugaagaaaggcaaggucguuaagucuguggaacuggacgcccccaauuaucacuacgaggaauguagcugcuauccugaugcuggcgagauuacgugugugugccgcgacaacuggcauggguccaauagacccugggucucuuucaaccagaaucuugaguaccagaucggauauaucugcagcggcguguuuggggauaacccucggcccaaugacggaacaggcuccugugggccgguuagcucuaacggagccuacggcgugaaaggcuucuccuuuaaguacgggaauggagucuggauuggccgcaccaaaagcacaaacucuagauccggguucgaaaugaucugggauccuaauggauggaccgagaccgacagcuccuuuucugugaagcaggacauuguugcgaucacagauuggagcggcuauuccgggucuuucgugcaacaccccgaacugacgggccucgacugcauucggccuuguuucugggucgagcugauccgcggaagacccaaagaaagcaccaucuggacauccggcagcucuauuuccuuuugcggggugaacagcgauaccgucggauggucuuggcccgacggcgccgagcuuccuuucacaaucgauaaguga

SEQ ID NO: 198057 - RNA, 1350 nt, Artificial Sequence
  derived and/or modified sequence opt5 from neuraminidase__InfluenzaA__ABE97710
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaauggaaaagggcaaagucguuaagucuguggagcugaaugcccccaacuaucauuacgaagaguguagcugcuauccugacgcuggcgagauuacgugugugugccgcgauaauuggcacggguccaacagacccugggucucuuucaaucagaaccuugaauaccagaucggauauaucugcagcggcguguuuggggacaauccucggcccaacgauggaacaggcuccugugggccgguuagcucuaauggagccuacggcgugaagggcuucuccuuuaaauacgggaacggagucuggauuggccgcaccaagagcacaaauucuagauccggguucgagaugaucugggacccuaacggauggaccgaaaccgauagcuccuuuucucugaaacaagacauuguggcgaucacagacuggagcggcuauuccgggucuuucguucagcaucccgagcucacgggccuggauugcauucggccuuguuucuggguggaacuuauccgcggaagacccaaggagagcaccaucuggacauccggcagcucuauuuccuuuugcggggucaauagcgacaccgugggauggucuuggcccgauggcgccgagcugccuuucacaaucgacaaauga

SEQ ID NO: 198058 - RNA, 1350 nt, Artificial Sequence
  derived and/or modified sequence opt5 from neuraminidase__InfluenzaA__ABE97711
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccgacggacaggcuagccacaagaucuuuaaaauggaaaagggcaaagucguuaagucuguggagcuggaugcccccaacuaucauuacgaagaguguagcugcuauccugacgcuggcgagauuacgugugugugccgcgauaauuggcacggguccaacagacccugggucucuuucaaucagaaccuugaauaccagaucggauauaucugcagcggcguguuuggggacaauccucggcccaacgauggaacaggcuccugugggccgguuagcucuaauggagccuacggcgugaagggcuucuccuuuaaauacgggaacggagucuggauuggccgcaccaagagcacaaauucuagauccggguucgagauggugugggacccuaacggauggaccgaaaccgacagcuccuuuucuguuaaacaagauaucguggcgauuacagacuggagcggcuauuccgggucuuucguccagcaucccgagcugacgggccucgauugcauccggccuuguuucuggguggaacugauucgcggaagacccaaggagagcaccaucuggacauccggcagcucuaucuccuuuugcggggucaauagcgacaccgugggauggucuuggcccgauggcgccgagcuuccuuucacaauugacaaauga

SEQ ID NO: 198059 - RNA, 1350 nt, Artificial Sequence; identical to SEQ ID NO: 198044
  derived and/or modified sequence opt5 from neuraminidase__InfluenzaA__ABE97712

SEQ ID NO: 198060 - RNA, 1350 nt, Artificial Sequence; identical to SEQ ID NO: 198044
  derived and/or modified sequence opt5 from neuraminidase__InfluenzaA__ABE97713

SEQ ID NO: 198061 - RNA, 1350 nt, Artificial Sequence; identical to SEQ ID NO: 198044
  derived and/or modified sequence opt5 from neuraminidase__InfluenzaA__ABE97715

SEQ ID NO: 198062 - RNA, 1350 nt, Artificial Sequence
  derived and/or modified sequence opt5 from neuraminidase__InfluenzaA__ABE97717
augaaccccaaucagaagaucauuaccaucggcagcauuugcauggugacagggaucgucaaccugaugcuccaaguuggaaauaugauuuccaucugggugucucacagcauccauacgggcaaccagcaccaggccgagccuauuuccaauaccaacuuccugacagaaaaagcuguggccucugucaaacuugcggggaauagcucccuguguccgaucaacggaugggcuguguacucuaaggacaauagcauuagaaucggcuccaagggggauguuuuugugauucgggagcccuucaucagcugcucucaucucgaaugucgcaccuuuuuccugacacagggagcccuucugaacgacaaacacuccaauggcaccgucaaggauagaagcccucaucggacacucaugucuugccccgugggcgaggccccuucccccuauaacagccgcuuugaaucuguugcuugguccgccagcgcuugucacgacgggaccuccuggcugacgauuggaaucucuggcccugauaauggggccguggcgguccugaaguacaacggaaucauuaccgacacaaucaaaagcuggagaaauaacauucuccggacccaagaguccgagugcgccugugugaacggcagcugcuucacagugaugaccgaugggccgucuaauggacaggcuucccacaagaucuuuaaaauggaaaagggcaaagucguuaagagcguggagcuggacgcccccaacuaucauuacgaagaguguucuugcuauccugaugcuggcgagauuacgugugugugccgcgacaauuggcacgggagcaacagacccugggucuccuucaaucagaaccuugaauaccagaucggauauaucugcucuggcguguuuggggauaauccucggcccaacgacggaacaggcagcugugggccgguuccuuccaauggagccuacggcgugaagggcuucagcuuuaaauacgggaacggagucuggauuggccgcaccaagucuacaaauuccagaagcggguucgagaugaucugggaucccaacggauggaccgaaaccgacucuuccuuuagcgugaaacaagacauuguugcgaucacagauugguccggcuauucugggagcuucgugcagcauccugagcugacgggccucgacugcauucggcccuguuucugggucgaacugauccgcggaagacccaaggaguccaccaucuggacaucuggcagcuccauuagcuuuugcggggucaauucugauaccgugggaugguccuggccugacggcgccgagcuuccguucacaaucgauaaauga

SEQ ID NO: 198063 - RNA, 1350 nt, Artificial Sequence
  derived and/or modified sequence opt5 from neuraminidase__InfluenzaA__ABE97718
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaauggaaaagggcaaagucguuaagucuguggagcuggacgcccccaauuaucauuacgaagaguguagcugcuauccugaugcuggcgagauuacgugugugugccgcgacaacuggcacggguccaauagacccugggucucuuucaaccagaaucuugaauaccagaucggauauaucugcagcggcguguuuggggauaacccucggcccaaugacggaacaggcuccugugggccgguuagcucuaacggagccuacggcgugaagggcuucuccuuuaaauacgggaauggagucuggauuggccgcaccaagagcacaaacucuagauccggguucgagaugaucugggauccuaauggauggaccgaaaccgacagcuccuuuucugugaaacaagacauuguugcgaucacagauuggagcggcuauuccgggucuuucgugcagcaucccgagcugacgggccucgacugcauucggccuuguuucugggucgaacugauccgcggaagacccaaggagagcaccaucuggacauccggcagcucuauuuccuuuugcgggguggauagcgacaccgucggauggucuuggcccgauggcgccgagcuuccuuucacaaucgacaaauga

SEQ ID NO: 198064 - RNA, 1350 nt, Artificial Sequence
  derived and/or modified sequence opt5 from neuraminidase__InfluenzaA__ABE97719
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacaccaauuuccugacagaaaaagcuguggccagcgucaaacuugcggggaacuccucucuguguccgaucaauggaugggcuguguacagcaaggacaacuccauuagaaucggcagcaagggggauguuuuugugauucgggagcccuucaucucuugcucccaucucgaaugucgcaccuuuuuccugacacagggagcccuucugaaugacaaacacagcaacggcaccgucaaggauagaucuccucaucggacacucauguccugccccgugggcgaggccccuagccccuauaauucucgcuuugaauccguugcuuggagcgccuccgcuugucacgacgggaccucuuggcugacgauuggaaucagcggcccugauaacggggccguggcgguccugaaguacaauggaaucauuaccgacacaaucaaauccuggagaaacaauauucuccggacccaagagagcgagugcgccugugugaacggcucuugcuucacagugaugaccgaugggccguccaacggacaggcuagccacaagaucuuuaaaaugaagaaaggcaaggucguuaagucuguggaacuggacgcccccaauuaucauuacgaggaauguagcugcuauccugaugcuggcgagauuacgugugugugccgcgacaacuggcacggguccaauagacccugggucucuuucaaccagaaucuugaguaccagaucggauauaucugcagcggcguguuuggggauaacccucggcccaaugacggaacaggcuccugugggccgguuagcucuaacggagccuacggcgugaaaggcuucuccuuuaaguacgggaauggagucuggauuggccgcaccaaaagcacaaacucuagauccggguucgaaaugaucugggauccuaauggauggaccgagaccgacagcuccuuuucugugaagcaagacauuguugcgaucacagauuggagcggcuauuccgggucuuucgugcagcaucccgaacugacgggccucgacugcauucggccuuguuucugggucgagcugauccgcggaagacccaaagaaagcaccaucuggacauccggcagcucuauuuccuuuugcggggugaacagcgauaccgucggauggucuuggcccgacggcgccgagcuuccuuucacaaucgauaaguga

SEQ ID NO: 198065 - RNA, 1350 nt, Artificial Sequence
  derived and/or modified sequence opt5 from neuraminidase__InfluenzaA__ABE97720
augaaccccaaucagaagaucauuaccaucggcagcauuugcauggugacagggaucgucucccugaugcuccaaguuggaaacaugauuucuaucugggugagccacuccauccauacgggcaaucagcaccaggccgagccuauuucuaacgcuaauuuccugaccgaaaaagccguggcgagcgucaaacuugcugggaacuccucucuguguccgaucaauggaugggccguguacagcaaggacaacuccauuagaaucggcagcaagggggauguuuuugugauucgggagcccuucaucucuugcucccaucucgaaugucgcacauuuuuccugacccagggagcccuucugaaugacaaacacagcaacggcacagucaaggauagaucuccucaucggacccucauguccugccccgugggcgaggcuccuagccccuauaauucucgcuuugaauccguugccuggagcgcuuccgccugucacgacgggacaucuuggcugaccauuggaaucagcggcccugauaacggggcgguggccguccugaaguacaauggaaucauuacggacaccaucaaauccuggagaaacaauauucuccggacacaagagagcgagugcgcuugugugaacggcucuugcuucaccgugaugacagaugggccguccaacggacaggccagccacaagaucuuuaaaauggaaaagggcaaagucguuaagucuguggagcuggacgcucccaauuaucauuacgaagaguguagcugcuauccugaugccggcgagauuaccugugugugccgcgacaacuggcacggguccaauagacccugggucucuuucaaccagaaucuugaauaccagaucggauauaucugcagcggcguguuuggggauacgccucggcccaacgacggaacaggcuccugugggccgguuagcucuaauggagcguacggcgugaagggcuucuccuuuaaauacgggaacggagucuggauuggccgcaccaagagcacaaauucuagauccggguucgagaugaucugggauccuaacggauggaccgaaaccgacagcuccuuuucugugaaacaagacauuguugccaucacagauuggagcggcuauuccgggucuuucgugcagcaucccgagcugacgggccucgacugcauucggccuuguuucugggucgaacugauccgcggaagacccaaggagagcaccaucuggacauccggcagcucuauuuccuuuugcggggugaauagcgauaccgucggauggucuuggcccgacggcgcugagcuuccuuucacaaucgauaaauga

SEQ ID NO: 198066 - RNA, 1410 nt, Artificial Sequence; identical to SEQ ID NO: 197837
  derived and/or modified sequence opt5 from neuraminidase__InfluenzaA__ABF47553

SEQ ID NO: 198067 - RNA, 1413 nt, Artificial Sequence; identical to SEQ ID NO: 197420
  derived and/or modified sequence opt5 from neuraminidase__InfluenzaA__ABF47564

SEQ ID NO: 198068 - RNA, 1413 nt, Artificial Sequence
  derived and/or modified sequence opt5 from neuraminidase__InfluenzaA__ABF47575
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucuguggcgcuggcuggcaauagcucccuuuguagcauuucugggugggccaucuacacaaaagauaacuccauucggaucggaagcaagggcgacgucuucgugauucgcgagccuuuuaucucuugcucccauuucgaguguagaaccuuuuuccugacgcaaggcgcccuccugaaugauaaacacagcaacgggaccguuaaggaccggucuccguaucgcgcucuuauguccugcccccugggagaagccccuagccccuacaauuccaaguuugagucuguggcuuggagcgccuccgcgugucaugauggcaugggguggcucacaaucggaauuagcggcccugacaacggggccgucgcugugcugaaauauaacggaaucauuaccgaaacaaucaagucuuggaaaaagcagauucugagaacccaggaguccgagugcguuugugugaauggcagcugcuucacgaucaugacagauggccccucuaacggggccgcuagcuacaaaaucuuuaagauugaaaagggaaaagucaccaaguccaucgagcucaaugccccuaacuuccacuaugaagaguguucuugcuacccggacacaggcaccgugaugugugugugccgggauaauuggcacgggagcaaccgccccugggucuccuuuaaucagaaccuggacuaccaaauuggauauaucugcagcggcguuuucggggauaauccuagacccaaagacggagagggcucuuguaacccugugaccguggauggcgcgaauggggucaagggauuuuccuacaaauauggcaacgggguguggauuggacggacaaagagcaaucgccuuagaaaaggcuucgaaaugaucugggaccccaacggguggacggacaccgauucugacuuuuccguuaagcaggauguggucgccauuacagacuggagcggcuacuccggaucuuucgugcagcauccggagcugaccggccucgauugcauccggccuuguuucuggguugaacuggugcgcgggcuucccaaggagaauacaaccaucuggacgagcggauccucuauuagcuuuugcggcgucaacuccgacacagcuaacuggagcuggccugauggggccgaacugcccuucaccaucgacaaauga

SEQ ID NO: 198069 - RNA, 1413 nt, Artificial Sequence; identical to SEQ ID NO: 197420
  derived and/or modified sequence opt5 from neuraminidase__InfluenzaA__ABF47586

SEQ ID NO: 198070 - RNA, 1410 nt, Artificial Sequence; identical to SEQ ID NO: 197150
  derived and/or modified sequence opt5 from neuraminidase__InfluenzaA__ABF47597

SEQ ID NO: 198071 - RNA, 1413 nt, Artificial Sequence; identical to SEQ ID NO: 197992
  derived and/or modified sequence opt5 from neuraminidase__InfluenzaA__ABF47608

SEQ ID NO: 198072 - RNA, 1410 nt, Artificial Sequence
  derived and/or modified sequence opt5 from neuraminidase__InfluenzaA__ABF47619
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccggcagagcggacacaaagauucuguuuaucgaggaaggaaaaaucguccacauuagcccucuuuccgggucugcccaacauguugaggaaugcagcuguuauccccgguacccuggagugcgcugcguguguagagauaacuggaagggcuccaaccggcccaucgucgacauuaaugugaaggauuacagcaucguuucuuccuaugugugcagcggccuggucggggacaccccgcgcaaaaacgacucugcuagcuccucucacugucucaauccuaacaaugaggaaggaggccauggggugaagggaugggccuucgaugacggcaacgauguuuggauggggagaacaauuagcgagaaacugcgguccggauacgagaccuuuaaggugaucggcggcuggagcaaacccaauucuaagcugcagaucaaccgccaggucauuguggacagagggaaucgguccggauauagcggcaucuucucugucgaagggaaauccugcauuaacagauguuuuuacguggagcucauccgcggacggaagcaggaaacggagguuugguggacaagcaauuccauuguggucuucugcggcaccucugggaccuauggcacaggaagcuggccugauggcgcugacaucaaccugaugcccauuuga

SEQ ID NO: 198073 - RNA, 1413 nt, Artificial Sequence
  derived and/or modified sequence opt5 from neuraminidase__InfluenzaA__ABF47630
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuauggcgcuggcuggcaauagcucccuuuguccuauccgggggugggccauuuacacaaaagauaacagcauccgcauuggaucuaagggcgacguguucgucaucagagaaccguuuaucuccugcagccaccuggagugucggaccuucuuucucacgcagggcgcccugcuuaaugauaaacauucuaacgggaccgugaaggaccgcucccccuauagagcucugaugagcugcccucucggagaagcccccucuccuuacaauucccgguucgagagcguugcuugguccgccucugcgugucacgauggccugggguggcugacaauuggaaucagcggccccgacaacggggccguggcuguccucaaguauaacggaauuaucaccgaaacaauuaaauccuggaagaaacgcauccugagaacccaggagagcgagugcguguguaugaauggcucuugcuuuacgaucaugacagauggcccuuccaacggggccgcuagcuaccggauuuucaagaucgaaaaaggacgcguuaccaagucuauugagcuugacgccccgaauuaucauuacgaagaguguagcugcuaccccgauacaggcaccgugaugugugucugcagagacaacuggcacggguccaaucggccuugggugucuuuuaaccagaaucuggauuaucaaaucggauacauuugcagcggcguguucggggacaacccccgcccuaaggauggagagggcuccuguaaucccgucaccguugacggcgcggacggggugaaaggauuuagcuauagauacggcaacgggguguggaucggacggacaaagucuaaucgccucagaaaaggcuucgaaaugauuugggauccgaacggguggacggacaccgauuccgacuuuagcaugaagcaggauaucgucgccaugacagacuggucuggcuauuccggauccuucgugcagcacccugagcugaccggccuugauugcaugcggcccuguuuuuggguugaacuggugagagggcucccucgcgagaauacaaccaucuggacguccggaucuagcauuuccuucugcggcgucaacucugacacagcuaauuggagcuggcccgauggggccgaacugcccuucaccaucgacaaauga

SEQ ID NO: 198074 - RNA, 1413 nt, Artificial Sequence
  derived and/or modified sequence opt5 from neuraminidase__InfluenzaA__ABF47652
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccaacaccggcaccgugaugugugucugcagagauaauuggcacggguccaaccggccuugggugucuuuuaaucagaaccuggacuaucaaaucggauacauuugcagcggcguguucggggauaauccccgcccuaaggacggagagggcuccuguaaccccgucacaguugauggcgccgacggggugaaaggauuuagcuauagauacggcaaugggguguggaucggacggacgaagucuaaccgccucagaaaaggcuucgaaaugauuugggacccgaauggguggaccgauacagacuccgauuuuagcaugaagcaggacaucgucgcgaugaccgauuggucuggcuauuccggauccuucgugcagcacccugagcugacaggccuugacugcaugcggcccuguuuuuggguugaacuggugagagggcucccucgcgagaacaccacgaucuggacauccggaucuagcauuuccuucugcggcgucaauucugauaccgccaacuggagcuggcccgacggggcugaacugcccuucaccaucgauaaauga

SEQ ID NO: 198075 - RNA, 1413 nt, Artificial Sequence; identical to SEQ ID NO: 197992
  derived and/or modified sequence opt5 from neuraminidase__InfluenzaA__ABF47663

SEQ ID NO: 198076 - RNA, 1413 nt, Artificial Sequence
  derived and/or modified sequence opt5 from neuraminidase__InfluenzaA__ABF47674
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcauccagagaauuaucaccuacgagaacuccacaugggucaaucacaccuauguuaacaucaauaacacaaaugugauugccggaaaagacaagaccucugugacacuggcgggcaacagcucccuuuguagcaucucugggugggcuauuuacaccaaagauaauuccauccggauuggaagcaagggcgacgucuucgugauccgcgaaccuuuuaucucuugcucccaucuggaguguagaacguucuuucucacccaaggcgcccugcuuaacgauaaacacagcaaugggacaguuaaggaccggucuccguaucgcgcccugauguccugcccccucggagaagcuccuagccccuacaacuccaaguucgagucuguggccuggagcgcuuccgccugucaugauggcaugggguggcugaccauuggaaucagcggcccugacaauggggcggucgccgugcugaaauauaacggaauuaucacagaaaccauuaagucuuggaaaaagcagauccucagaacgcaggaguccgagugcguuugugugaacggcagcugcuuuacaaucaugaccgauggccccucuaauggggcugccagcuacaaaauuuucaagaucgaaaagggaaaagucacaaaguccauugagcugaacgcuccuaauuuucacuaugaagaguguucuugcuacccggacaccggcaccgugaugugugugugccgggauaacuggcacgggagcaaucgccccugggucuccuucaaccagaaucuugacuaccaaaucggauauauuugcagcggcguuuuuggggauaacccuagacccaaagacggagagggcucuuguaauccugugacaguggauggcgccaacggggucaagggauucuccuacaaauauggcaaugggguguggaucggacggaccaagagcaaccgccugagaaaaggcuuugaaaugauuugggaccccaauggguggacggacacagauucugacuucuccguuaagcaggauguggucgcgaucaccgacuggagcggcuacuccggaucuuuugugcagcauccggagcucacaggccuggauugcauccggccuuguuucuggguugaacuugugcgcgggcugcccaaggagaacaccacgauuuggacaagcggauccucuaucagcuucugcggcgucaauuccgacaccgccaacuggagcuggccugauggggcugaacuccccuuuaccauugacaaauga

SEQ ID NO: 198077 - RNA, 1413 nt, Artificial Sequence; identical to SEQ ID NO: 197975
  derived and/or modified sequence opt5 from neuraminidase__InfluenzaA__ABF47696

SEQ ID NO: 198078 - RNA, 1413 nt, Artificial Sequence
  derived and/or modified sequence opt5 from neuraminidase__InfluenzaA__ABF47707
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaaggcaccacaucuaugacccuggccgggaacagcucccuuugcccuauucggggaugggcgaucuacagcaaggacaauucuauucgcaucggcuccaaaggcgaugucuucgugauuagagaaccguuuaucagcuguucucaccuggagugccggacguucuuucucacccagggggcucugcuuaacgacaagcauuccaauggaacaguuaaagaucgcagccccuauagagcccugaugucuuguccuaucggcgaagcccccuccccuuacaacagccgguucgaguccguggcuuggucugccagcgcuugccacgacgggaugggauggcucaccauuggcaucuccgggcccgaugacggagccgucgcggugcugaaguauaauggcauuaucacagaaaccauuaagagcuggcgcaaacagauccugagaacgcaggagucugaguguguuugcgugaacggcuccuguuuuacaaucaugaccgaugggccuagcgacggaccggccucuuaccggauuuucaagaucgaaaaaggcaagauuacaaaaagcaucgagcucgaugcucccaacucccauuaugaagagugcucuuguuacccugacaccgggaccgucaugugcgugugccgcgauaauuggcacggaagcaacagacccuggguguccuuuaaucaaaaccuggacuaccagauuggcuauaucuguagcggggucuucggagauaauccucggcccaaggacggcaagggcucuugcgacccgguuaacguggauggggccgacggagugaaaggcuuuuccuaccgcuaugggaauggagucuggauuggcagaacaaagagcaacucuucccggaaaggguucgagaugaucugggauccuaauggcuggacggacaccgauagcaacuuucuugugaagcaggacguuguggcuaugacagauugguccggauacucuggcagcuucguccagcaccccgaacugaccgggcucgacuguaugcgcccuugcuuuuggguggagcugaucagaggacggcccagagagaaaacaaccauuuggacguccggcucuagcaucuccuucugugggguuaauagcgauacagugaacuggucuuggcccgacggagccgaacuuccuuucaccauugauaaguga

SEQ ID NO: 198079 - RNA, 1413 nt, Artificial Sequence; identical to SEQ ID NO: 197975
  derived and/or modified sequence opt5 from neuraminidase__InfluenzaA__ABF47718

SEQ ID NO: 198080 - RNA, 1413 nt, Artificial Sequence; identical to SEQ ID NO: 197975
  derived and/or modified sequence opt5 from neuraminidase__InfluenzaA__ABF47729

SEQ ID NO: 198081 - RNA, 1413 nt, Artificial Sequence; identical to SEQ ID NO: 197975
  derived and/or modified sequence opt5 from neuraminidase__InfluenzaA__ABF47740

SEQ ID NO: 198082 - RNA, 1413 nt, Artificial Sequence
  derived and/or modified sequence opt5 from neuraminidase__InfluenzaA__ABF47751
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucaacaauacaaacgugguggcuggaaaagacaccacauccgucacccuggccggcaauucuagccuuugcccuauucgggggugggcgaucuacuccaaggauaacagcauucgcaucggaucuaaaggcgacguguucguuauuagagaaccguuuaucuccuguagccaccuggagugccggacguucuuucucacccagggcgcucugcuuaaugauaagcauucuaacgggacagugaaagaccgcucccccuauagagcccugaugagcuguccuaucggagaagcccccucuccuuacaauucccgguucgagagcgucgcuugguccgccucugcuugccacgauggcaugggguggcucaccauuggaaucagcggccccgacgauggggccguggcgguucugaaguauaacggaauuaucacagaaaccauuaaguccuggcgcaaaagaauccugcggacgcaggagagcgagugugugugcgucaacggcucuuguuuuacaaucaugaccgacggcccuuccaaugggccggccagcuaccgcauuuucaagaucgaaaaaggaaagauuacaaaaucuaucgagcucgaugcucccaacagccauuaugaagagugcuccuguuacccugacaccggcaccgugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugacaguggauggcgccgacggggucaaaggauuuucuuacagauauggcaacgggguguggauuggacggacgaaguccaauagcucucgcaaaggcuucgagaugaucugggauccuaacggguggaccgacacagauuccaauuuucuuguuaagcaggacguggucgcuaugaccgauuggagcggcuacuccggaucuuucgugcagcaccccgaacugacaggccucgacuguaugagaccuugcuuuuggguugagcugauccgggggagaccccgcgagaaaaccacgauuuggacaagcggauccucuaucagcuucuguggcgugaacuccgauaccgccaauuggagcuggcccgacggggcggaacuuccuuucaccauugauaaguga

SEQ ID NO: 198083 - RNA, 1413 nt, Artificial Sequence
  derived and/or modified sequence opt5 from neuraminidase__InfluenzaA__ABF47773
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagcuaccgcauuuucaagaucgaaaaaggaaagauuaccaaaucuaucgagcucgaugcccccaacagccauuaugaagagugcuccuguuacccugacaccggcacagugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugacgguggauggcgcugacggggucaaaggauuuucuuacagauauggcaacgggguguggauuggacggaccaaguccaauagcucucgcaaaggcuucgagaugaucugggauccuaacggguggacagacaccgauuccaauuuucuuguuaagcaggacguggucgccaugacagauuggagcggcuacuccggaucuuucgugcagcaccccgaacugaccggccucgacuguaugagaccuugcuuuuggguugagcugauccgggggagaccccgcgagaaaacgacaauuuggaccagcggauccucuaucagcuucuguggcgugaacuccgauaccgcuaauuggagcuggcccgacggggccgaacuuccuuucacaauugauaaguga

SEQ ID NO: 198084 - RNA, 1413 nt, Artificial Sequence; identical to SEQ ID NO: 198083
  derived and/or modified sequence opt5 from neuraminidase__InfluenzaA__ABF47784

SEQ ID NO: 198085 - RNA, 1413 nt, Artificial Sequence; identical to SEQ ID NO: 198083
  derived and/or modified sequence opt5 from neuraminidase__InfluenzaA__ABF47795

SEQ ID NO: 198086 - RNA, 1413 nt, Artificial Sequence; identical to SEQ ID NO: 198083
  derived and/or modified sequence opt5 from neuraminidase__InfluenzaA__ABF47806

SEQ ID NO: 198087 - RNA, 1413 nt, Artificial Sequence; identical to SEQ ID NO: 198083
  derived and/or modified sequence opt5 from neuraminidase__InfluenzaA__ABF47817

SEQ ID NO: 198088 - RNA, 1413 nt, Artificial Sequence; identical to SEQ ID NO: 198083
  derived and/or modified sequence opt5 from neuraminidase__InfluenzaA__ABF47839

SEQ ID NO: 198089 - RNA, 1413 nt, Artificial Sequence; identical to SEQ ID NO: 198083
  derived and/or modified sequence opt5 from neuraminidase__InfluenzaA__ABF47850

SEQ ID NO: 198090 - RNA, 1413 nt, Artificial Sequence; identical to SEQ ID NO: 197852
  derived and/or modified sequence opt5 from neuraminidase__InfluenzaA__ABF47872

SEQ ID NO: 198091 - RNA, 1413 nt, Artificial Sequence; identical to SEQ ID NO: 197852
  derived and/or modified sequence opt5 from neuraminidase__InfluenzaA__ABF47883

SEQ ID NO: 198092 - RNA, 1413 nt, Artificial Sequence; identical to SEQ ID NO: 197852
  derived and/or modified sequence opt5 from neuraminidase__InfluenzaA__ABF47894

SEQ ID NO: 198093 - RNA, 1410 nt, Artificial Sequence; identical to SEQ ID NO: 197868
  derived and/or modified sequence opt5 from neuraminidase__InfluenzaA__ABF47905

SEQ ID NO: 198094 - RNA, 1362 nt, Artificial Sequence
  derived and/or modified sequence opt5 from neuraminidase__InfluenzaA__ABF47958
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaucuauuaccuacaaaguuguggccggccaagacagcacauccgugauccugaccgggaacucuagccuuugcccuaucagaggaugggcuauucacuccaaggauaauggcauccggauuggcagcaaaggggacgucuucgugauccgcgagccguuuauuucuuguucccaucuggaaugcagaacauucuuucucacccagggagcccugcuuaacgauaagcacagccggggcacauucaaagaccgcucucccuauagagcgcugauguccuguccuguuggggaggcucccagcccuuacaauucucgguuugaauccguggccuggagcgccuccgcuugccaugauggaaugggcuggcucaccaucgggaucucuggacccgacgauggcgccgucgcugugcugaaguauaacggcauuaucacggagaccauuaagagcuggcgcaaaaauauccugagaacacaggaauccgaguguaccugcguuaacgggagcuguuucacaauuaugaccgacggaccuucugauggccucgccuccuacaagaucuuuaaaaucgagaaggggaaagugacaaagagcauugaacugaaugcgccgaacucucacuaugaggaaugcagcuguuaccccgacacgggaaaggucaugugcgugugccgggauaauuggcacggcuccaaccgcccuugggugucuuucgaccagaaccuugauuauaaaaucggguacauuuguagcggagucuuuggcgacaaucccagaccuaaggacggcaccggguccugcggacccguuagcgccgauggcgcuaacggggugaaaggauucucuuacaaguauggcaaugggguguggaucggccggacaaaauccgacagcucucgccauggauuugagaugauuugggauccgaacggcuggaccgagaccgacuccagauucagcaugcggcaagaugucguggccaugacagaccgcuccggguacucuggcagcuuuguucagcacccugaacugacgggacucgauuguaugagacccugcuucuggguggagcugauccgggggcuuccugaagaggacgcuauuuggaccuccggaucuaucaucagcuucuguggcgucaauuccgauacaguggacuggagcuggcccgauggggccgaacugcccuuuaccauugacaaguga

SEQ ID NO: 198095 - RNA, 1350 nt, Artificial Sequence
  derived and/or modified sequence opt5 from neuraminidase__InfluenzaA__ABF56651
augaaccccaaucagaagaucauuaccaucggcagcauuugcauggugacagggaucgucucccugaugcuccaaguuggaaacaugauuucuaucugggugagccacuccauccauacgggcucucagcaccaggccgagccuauuagcaauaccaacuuccugacagaaaaagcuguggccuccgucaaacuugcgggcaauucuagccuguguccgaucaacggaugggcuguguacuccaaggacaauagcauuagaaucggcucuaagggggauguuuuugugauucgggagcccuucaucuccugcagccaucucgaaugucgcaccuuuuuccugacacagggagcccuucugaacgacaaacacucuaauggcaccgucaaggauagauccccucaucggacacucaugagcugccccgugggcgaggccccuucucccuauaacucccgcuuugaaagcguugcuugguccgccucugcuugucacgacgggaccagcuggcugacgauuggaaucuccggcccugauaauggggccguggcgguccugaaguacaacggaaucauuaccgacacaaucaaaagcuggagaaauaacauucuccggacccaagagucugagugcgccugugugaauggcuccugcuucacagugaugaccgaugggccgagcaacggacaggcuucucacaagaucuuuaaaauggaaaagggcaaagucguuaagagcguggagcuggacgcccccaacuaucauuacgaagaguguuccugcuauccugaugcuggcgagauuacgugugugugccgcgacaauuggcacgggucuaacagacccugggucagcuucaaucagaaccuugaauaccagaucggauauaucugcuccggcguguuuggggauaauccucggcccaacgacggaacaggcagcugugggccgguuucuuccaauggagccuacggcgugaagggcuucagcuuuaaauacgggaacggagucuggauuggccgcaccaagucuacaaauuccagaagcggguucgagaugaucugggauccuaacggauggaccgaaaccgacuccucuuuuagcgugaaacaagacauuguugcgaucacagauugguccggcuauucugggagcuucgugcagcaucccgagcugacgggccucgacugcauucggccuuguuucugggucgaacugauccgcggaagacccaaggaguccaccaucuggacaagcgggucuuccauuagcuuuugcggggucaauucugauaccgugggaugguccuggcccgacggcgccgagcuuccuuucacaaucgauaaauga

SEQ ID NO: 198096 - RNA, 1410 nt, Artificial Sequence; identical to SEQ ID NO: 197851
  derived and/or modified sequence opt5 from neuraminidase__InfluenzaA__ABF82654

SEQ ID NO: 198097 - RNA, 1413 nt, Artificial Sequence; identical to SEQ ID NO: 197420
  derived and/or modified sequence opt5 from neuraminidase__InfluenzaA__ABF82665

SEQ ID NO: 198098 - RNA, 1413 nt, Artificial Sequence; identical to SEQ ID NO: 197420
  derived and/or modified sequence opt5 from neuraminidase__InfluenzaA__ABF82676

SEQ ID NO: 198099 - RNA, 1413 nt, Artificial Sequence
  derived and/or modified sequence opt5 from neuraminidase__InfluenzaA__ABF82687
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaaacaaccaaguccaucgagcugaaugcuccuaacuuucacuaugaagaguguucuugcuacccggacaccggcacagucaugugugugugccgggauaauuggcacgggagcaaccgccccuggguguccuucaaucagaaccuugacuaccaaauuggauauaucugcagcggcgucuuuggggauaauccuagacccaaagacggagagggcucuuguaacccuguuacgguggauggcgccaauggggugaagggauucuccuacaaauauggcaacggggucuggauuggacggaccaagagcaaucgccugagaaaaggcuuugaaaugaucugggaccccaacggguggacagacaccgauucugacuucuccgugaagcaggauguuguggcgauuacagacuggagcggcuacuccggaucuuuuguccagcauccggagcucaccggccugaauugcauccggccuuguuucuggguggaacuuguucgcgggcugcccaaggagaacacgacaaucuggaccagcggauccucuauuagcuucugcggcgugaacuccgauaccgccaauuggagcuggccugacggggcugaacuccccuuuacaaucgauaaauga

SEQ ID NO: 198100 - RNA, 1410 nt, Artificial Sequence
  derived and/or modified sequence opt5 from neuraminidase__InfluenzaA__ABF82698
augaaccccaaucagaagaucauuaccaucggcagcgugucccugacaauuacgaccaucugcuuccucaugcaaauugccauccuggucaucacaguuacccuucacuuuaaacagugugagugcaacucuccuccgaauaaccaggugaugcugugugaacccacaauuaucgagagaaauauuaccgaaaucguguaccucacaaacaccacgauugagaaggaaaucugcccuaaacuggcugaguaucggaauuggagcaagccccaguguaaaauuaccggguucgccccuuuuuccaaggacaacucuauccgccuuagcgcgggaggcgauaucugggucacaagagagcccuacguguccugcgacccugggaaguguuaucaauucgcucugggacagggcaccacacucaauaaccggcauucuaaugauaccguucacgaccgcacgccguacagaacacugcugaugaacgaacucggggugcccuuucaucugggaaccaaacaggucugcauugccuggagcuccagcucuugucacgauggcaaggccuggcuucaugugugcguuacaggccacaaugagaacgcuaccgccuccuucaucuaugacgggcggcugguggauagcauuggaucuugguccaaaaauauccuccgcacccaggaaagcgagugugucugcauuaacggcacaugcacgguggugaugaccgacgggucugcuuccgggagagccgauacaaagauccuguuuaucgaggaaggcaaaauuguccacaucagcccucuuuccgggucugcgcaacauguugaggaauguagcugcuacccccgguauccuggagugcgcugugugugcagagacaacuggaagggcuccaaucggcccauugucgauaucaacgugaaggacuacagcauuguuucuuccuacguguguagcggccuggucggggauaccccgcgcaaaaaugacucuagcuccucuagcuauugccucgacccuaacaaugaggaaggaggccacggggugaagggaugggccuucgaugacggcaacgauguuuggauggggagaacaaucuccgagaaacugcggagcggauacgagaccuuuaaggugaucggcggcuggucuaaacccaauuccaagcugcagauuaaccgccaggucaucguggacaaagggaauagaagcggauauucuggcauuuucuccgucgaaggaaagagcuguacgaaccggugcuuuuacguggagcucaucagaggacgcaagcaggaaacagagguuugguggaccuccaauucuauuguggucuucuguggcaccagcgggacauauggcaccggauccuggccugauggcgcugacaucaaccugaugcccauuuga

SEQ ID NO: 198101 - RNA, 1410 nt, Artificial Sequence; identical to SEQ ID NO: 197150
  derived and/or modified sequence opt5 from neuraminidase__InfluenzaA__ABF82709

SEQ ID NO: 198102 - RNA, 1413 nt, Artificial Sequence; identical to SEQ ID NO: 197439
  derived and/or modified sequence opt5 from neuraminidase__InfluenzaA__ABF82822

SEQ ID NO: 198103 - RNA, 1413 nt, Artificial Sequence; identical to SEQ ID NO: 197420
  derived and/or modified sequence opt5 from neuraminidase__InfluenzaA__ABF82833

SEQ ID NO: 198104 - RNA, 1413 nt, Artificial Sequence; identical to SEQ ID NO: 197420
  derived and/or modified sequence opt5 from neuraminidase__InfluenzaA__ABF82844

SEQ ID NO: 198105 - RNA, 1413 nt, Artificial Sequence
  derived and/or modified sequence opt5 from neuraminidase__InfluenzaA__ABF82855
augaaccccaaucagaagaucauuaccaucggcagcauuuccaucgccauugggaucaucucucugaugcuccaaauuggaaacaucauuagcaucugggcuucccacucuauucagaucggcagccagaaucauacaggggugugcaaccagagaauuaucacguacgaaaauuccaccugggucaaccacacauauguuaauaucaacaauaccaacgugauugccggaaaagacaagacaucugugacccuggcgggcaauagcucccuuuguagcaucucugggugggcuauuuacacaaaagauaacuccauccggauuggaagcaagggcgacgucuucgugauccgcgagccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagcagauccucagaacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugaccguggauggcgccaauggggucaagggauucuccuacaaauauggcaacgggguguggaucggacggacaaagagcaaucgccugagaaaaggcuuugaaaugauuugggaccccaacggguggacggacaccgauucugacuucuccguuaagcaggauguggucgcgaucacagacuggagcggcuacuccggaucuuuugugcagcauccggagcucaccggccuggauugcauccggccuuguuucuggguugaacuugugcgcgggcugcccaaggagaauacaaccauuuggacgagcggauccucuaucagcuucugcggcgucaacuccgacacagccaacuggagcuggccugauggggcugaacuccccuuuaccauugacaaauga

SEQ ID NO: 198106 - RNA, 1413 nt, Artificial Sequence; identical to SEQ ID NO: 197420
  derived and/or modified sequence opt5 from neuraminidase__InfluenzaA__ABF82866

SEQ ID NO: 198107 - RNA, 1413 nt, Artificial Sequence; identical to SEQ ID NO: 197954
  derived and/or modified sequence opt5 from neuraminidase__InfluenzaA__ABF82888

SEQ ID NO: 198108 - RNA, 1413 nt, Artificial Sequence; identical to SEQ ID NO: 197420
  derived and/or modified sequence opt5 from neuraminidase__InfluenzaA__ABF82910

SEQ ID NO: 198109 - RNA, 1413 nt, Artificial Sequence; identical to SEQ ID NO: 197420
  derived and/or modified sequence opt5 from neuraminidase__InfluenzaA__ABF82921

SEQ ID NO: 198110 - RNA, 1413 nt, Artificial Sequence; identical to SEQ ID NO: 197420
  derived and/or modified sequence opt5 from neuraminidase__InfluenzaA__ABF82932

SEQ ID NO: 198111 - RNA, 1413 nt, Artificial Sequence; identical to SEQ ID NO: 197420
  derived and/or modified sequence opt5 from neuraminidase__InfluenzaA__ABF82943

SEQ ID NO: 198112 - RNA, 1350 nt, Artificial Sequence
  derived and/or modified sequence opt5 from neuraminidase__InfluenzaA__ABG20474
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucucgcggggauguguuuguuauuagagagcccuucaucuccugcagccaucucgaaugucggaccuuuuuccugacacaaggagcccuucugaaugacaagcacucuaacggcaccgugaaagaucgcuccccuuauagaacacucaugagcugccccgucggcgaggccccuucucccuacaauucccgguuugaaagcguggcuugguccgccucugcuugucaugacgggaccagcuggcugacgaucggaauuuccggcccugauaacggggccguugcggugcugaaguauaauggaaucauuaccgacacaaucaagagcuggcgcaacaauguccucagaacccaggagucugagugcgccugugugaacggcuccugcuucacagugaugaccgaugggccgagcaauggacaggcuucuuacaaaauuuuuaagauggaaaaaggcaaggucguuaaaagcguggagcuggacgcccccaacuaucacuacgaagaguguuccugcuauccugaugcuggcgagaucacgugugugugccgggacaacuggcaugggucuaaucgccccugggucagcuucaaccagaaucuugaauaccaaaucggauacauuugcuccggcguguuuggggauaacccuagacccaaugacggaacaggcagcugugggccgguuucuccuaacggagccuauggcgugaagggcuucuccuuuaaguacgggaauggagucuggaucggccggaccaaaagcacaaacucucgcuccggguucgagaugauuugggaucccaauggauggaccggcaccgacagcaacuuuuccgugaagcaggacaucguugcgauuacagauuggucuggguauagcggcuccuucgugcagcacccugaacugacgggacucgacugcaucagacccuguuucugggucgagcugauccggggccgccccaaagaaucuaccauuuggacaagcggguccagcaucuuuuucugcggagucaauucugauaccguguccuggagcuggccugacggcgccgagcuuccguuuacaauugauaaguga

SEQ ID NO: 198113 - RNA, 1410 nt, Artificial Sequence; identical to SEQ ID NO: 197150
  derived and/or modified sequence opt5 from neuraminidase__InfluenzaA__ABG26761

SEQ ID NO: 198114 - RNA, 1410 nt, Artificial Sequence
  derived and/or modified sequence opt5 from neuraminidase__InfluenzaA__ABG26772
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucaaggagggaaagaucguccacauuagcccucuuuccggcucugcccaacauguugaagagugcagcuguuauccccgguacccuggggugcgcugcguguguagagacaauuggaaaggauccaaccggcccaucgucgauauuaacgugaaggacuacagcaucguuucuuccuaugugugcagcggccuggucggcgacaccccgcgcaaaaaugauucuagcuccucuagccacugucucaacccuaauaacgaagaagggggacauggcgugaaggggugggcuuucgacgauggaaaugacguuuggaugggcagaacaauuuccgagaaacugcggagcggguacgagaccuuuaaggugaucgagggauggucuaaacccaacuccaagcugcagaucaaucgccaggucauuguggauagaggcaaccggagcggcuauucugggaucuucuccgucgaaggaaagagcugcauuaauagauguuuuuacguggagcucauccgcggccggaaacaggaaacggagguuugguggacauccaacucuauuguggucuucugcgggaccagcggaaccuauggcacaggguccuggccugacggcgccgauaucaaucugaugcccauuuga

SEQ ID NO: 198115 - RNA, 1413 nt, Artificial Sequence
  derived and/or modified sequence opt5 from neuraminidase__InfluenzaA__ABG26783
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccaacaccggcaccgugaugugugucugcagagauaauuggcacggguccaaccggccuugggugucuuuuaaucagaaccuggacuaucaaaucggauacauuugcagcggcguguucggggauaauccccgcccuaaggacggagagggcuccuguaaccccgucacaguugauggcgccgacggggugaaaggauuuagcuauagauacggcaaugggguguggaucggacggacgaagucuaaccgccucagaaaaggcuucgaaaugauuugggacccgaauggguggaccgauacagacuccgauuuuagcaugaagcaggacaucgucgcgaugaccgauuggucuggcuauuccggauccuucgugcagcacccugagcugacaggccuugacugcauccggcccuguuuuuggguugaacuggugagagggcucccucgcgagaacaccacgauuuggacauccggaucuagcaucuccuucugcggcgucaauucugauaccgccaacuggagcuggcccgacggggcugaacugcccuucaccauugauaaauga

SEQ ID NO: 198116 - RNA, 1413 nt, Artificial Sequence; identical to SEQ ID NO: 197992
  derived and/or modified sequence opt5 from neuraminidase__InfluenzaA__ABG26794

SEQ ID NO: 198117 - RNA, 1410 nt, Artificial Sequence
  derived and/or modified sequence opt5 from neuraminidase__InfluenzaA__ABG26805
augaaccccaaucagaagaucauuaccaucggcagcgugucccugacaauugccacgaucugcuuccucacccaaauugcuauccuggucacaaccguuacacuucacuuuaaacaguacgaguguucuagcccuccgaacaaucaggugaugcccugcgaaccuaucauuaucgagagaaacauuaccgaaaucguguaucugacaaauaccacgauugagaaggaaaucugucccaaacucgucgaguaccggaacugguccaagccucagugcaaaauuaccggguucgcccccuuuucuaaggacaauagcauccgccuguccgcgggaggcgauaucugggugacaagagagccuuauguuucuugugacccggggaagugcuaccaauucgcucuuggacagggcaccacacugaacaauaaacauagcaacgauaccauucacgaccggacgcccuaucgcacacuccugaugaaugaacugggggugccuuuucaucucggaaccaagcaggucuguaucgccugguccuccucuuccugccacgauggcaaagccuggcugcauguguguauuacaggccacgacaagaacgcuaccgccagcuucaucuacgaugggagacuuguugacucuauuggauccuggagcaaaaauauccugcggacccaggagucugaaugcguguguaucaacggcacaugcacggucgugaugaccgauggguccgcuagcgagcgcgccgacacaaagauucucuuuaucgaggaaggaaagauugugcacaucagcccccugucuggcagcgcgcaacaugucgaggaaugcuccuguuauccuagauaccccgggguucggugcgugugucgcgauaauuggaaaggaagcaacagaccgauuguggacaucaacgucaaggauuacucuaucguguccagcuauguuugcucuggccuugugggcgacaccccucggaaaaaugaccgcagcuccucuagcuacuguagaaaccccaauaacgagaaggggaaucacggagucaaaggcugggccuucgaugacgggaacgauguguggaugggacggacaauuggcgaggaacugcgcuccggguaugagaccuuuaagguuaucggaggcuggagcacgccuaauucuaaacuccagauuaacagacagaucauuguggacuccggcaaucggagcggguacucuggaaucuucuccgucgaaggcaagagcugcauuaacagauguuuuuauguggagcugauccgcgggcgggaacaggagacaagagucugguggaccuccaauucuaucgugguuuucugcggaaccagcggcacauacgggaccggcuccuggcccgauggagcugacauuaaccugaugcccaucuga

SEQ ID NO: 198118 - RNA, 1413 nt, Artificial Sequence; identical to SEQ ID NO: 197975
  derived and/or modified sequence opt5 from neuraminidase__InfluenzaA__ABG26816

SEQ ID NO: 198119 - RNA, 1413 nt, Artificial Sequence; identical to SEQ ID NO: 198083
  derived and/or modified sequence opt5 from neuraminidase__InfluenzaA__ABG26827

SEQ ID NO: 198120 - RNA, 1413 nt, Artificial Sequence; identical to SEQ ID NO: 198083
  derived and/or modified sequence opt5 from neuraminidase__InfluenzaA__ABG26838

SEQ ID NO: 198121 - RNA, 1410 nt, Artificial Sequence
  derived and/or modified sequence opt5 from neuraminidase__InfluenzaA__ABG26860
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgacagagcggauacaaagauucuguuuaucgaggaaggaaaaaucguccacauuagcccucuuuccggcucugcccaacauguugaggaaugcagcuguuauccccgguacccuggggugcgcugcguguguagagacaacuggaagggauccaaccggcccaucauugauaucaaugucaaggacuacagcauugugucuuccuauguuugcagcggccuggugggcgacaccccgcgcaaaaacgauucuagcuccucuagcuacuguuggaauccuaacaaugagaaagggggacacggcgucaaggggugggcuuucgacgauggaaacgacguguggaugggcagaacaaucuccgaagagagccggucuggguaugagaccuuuaagguuaucggaggcugguccaaacccaauagcaagcuccagauuaaccgccaggugaucgucgauagaggcaaucggucuggguacuccggaauuuucagcguggaaggcaaauccugcaucaacagauguuuuuaugucgagcugauucgcgggcggaagcaggaaacggaggugugguggacaucuaauagcaucguuguguucugcggaaccuccggcaccuacgggacaggcucuuggccugacggagccgauauuaaccugaugcccaucuga

SEQ ID NO: 198122 - RNA, 1410 nt, Artificial Sequence
  derived and/or modified sequence opt5 from neuraminidase__InfluenzaA__ABG26871
augaaccccaaucagaagaucauuaccaucggcagcgugucccugacaauugccacgaucugcuuccucaugcaaauugcuauccuggucaccacaguuacccuucacuuuaaacaguacgaguguaacucuccuccguauaaucagaucaugcugugcgaacccacaauuaucgagagaaacauuaccgaaaucguguaccucacaaauaccacgauugagaaggaaaucuguccuaaacuggccgaguaucggaacuggagcaagccccagugcaaaauuaccggguucgcgccuuuuuccaaggacaauucuauccgccuuagcgcuggaggcgauaucugggugacaagagagcccuacgucuccugugacccugggaagugcuaucaauucgcccugggacagggcaccacacucaacaaucggcauucuaacgauaccgugcacgaccgcacgccguacagaacacugcugaugaaugaacucgggguucccuuucaucugggaaccaaacagguguguauugccuggagcuccagcucuugccacgauggcaaggcuuggcuucaugucugugugacaggccacgacgagaacgccaccgcuuccuucaucuaugaugggcggcugguugacagcauuggaucuugguccaaaaauauccuccgcacccaggaaagcgagugcguguguauuaacggcacaugcacggucgugaugaccgaugggucugccuccgacagagcggauacaaagauccuguuuaucgaggaaggaaaaauugugcacaucagcccucuuuccggcucugcccaacaugucgaggaaugcagcuguuacccccgguacccugggguucgcugcguguguagagacaauuggaagggauccaaccggcccauuguggauaucaacgucaaggacuauagcauugugucuuccuacguuugcagcggccuggugggcgacaccccgcgcaaaaaugauucuagcuccucuagcuauuguuggaacccuaauaacgagaaagggggacacggcgucaaggggugggcuuucgacgauggaaaugacguguggaugggcagaacaaucuccgaagagagccggucuggguacgagaccuuuaagguuaucggaggcugguccaaacccaacagcaagcuccagauuaaucgccaggugaucgucgauagaggcaaccggucuggguauuccggaauuuucagcguggaaggcaaauccugcaucaauagauguuuuuacgucgagcugauucgcgggcggaagcaggaaacggaggugugguggacaucuaacagcaucguuguguucugcggaaccuccggcaccuaugggacaggcucuuggccugacggagccgauauuaaucugaugcccaucuga

SEQ ID NO: 198123 - RNA, 1410 nt, Artificial Sequence
  derived and/or modified sequence opt5 from neuraminidase__InfluenzaA__ABG26893
augaaccccaaucagaagaucauuaccaucggcagcauuucccugacaaucgccacgauuugcuuccucaugcaaaucgcuauccuggugaccacagucacccuucacuuuaaacaguacgaguguaacucuccuccgaauaaccagguuaugcugugcgaacccacaauuaucgagagaaauauuaccgaaaucguguaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauaucugggugacaagagagcccuaugucuccugugacccugggaagugcuaccaauucgcccugggacagggcaccacacucaauaaccggcauucuaaugauaccgugcacgaccgcacgccguauagaacacugcugaugaacgaacucgggguucccuuucaucugggaaccaaacagguguguauugccuggagcuccagcucuugccacgauggcaaggcuuggcuucaugucugugugacaggccacgacgagaaugccaccgcuuccuucaucuacgaugggcggcugguugacagcauuggaucuugguccaaaaacauccuccgcacccaggaaagcgagugcguguguauuaauggcacaugcacggucgugaugaccgaugggucugccuccgacagagcggauacaaagauccuguuuaucgaggaaggaaaaauugugcacaucagcccucuuuccggcucugcccaacaugucgaggaaugcagcuguuauccccgguacccugggguucgcugcguguguagagacaacuggaagggauccaaccggcccauuguggauaucaaugucaaggacuacagcauugugucuuccuauguuugcagcggccuggugggcgacaccccgcgcaaaaacgauucuagcuccucuagcuacuguuggaauccuaacaaugagaaagggggacacggcgucaaggggugggcuuucgacgauggaaacgacguguggaugggcagaacaaucuccgaagagagccggucuggguaugagaccuuuaagguuaucggaggcugguccaaacccaauagcaagcuccagauuaaccgccaggugaucgucgauagaggcaaucggucuggguacuccggaauuuucagcguggaaggcaaauccugcaucaacagauguuuuuaugucgagcugauucgcgggcggaagcaggaaacggaggugugguggacaucuaauagcaucguuguguucugcggaaccuccggcaccuacgggacaggcucuuggccugacggagccgauauuaaccugaugcccaucuga

SEQ ID NO: 198124 - RNA, 1410 nt, Artificial Sequence
  derived and/or modified sequence opt5 from neuraminidase__InfluenzaA__ABG26915
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucucuuccuggagcaaaaacauucuccgcacccaggaaucugagugcgucuguaucaauggaacaugcacgguggugaugaccgauggcuccgccagcgagagagcggacacaaagauucuguuuaucgaagaggggaaaaucguccacauuuccccucuuucuggaagcgcccaacauguugaagagugcuccuguuauccccgguacccuggcgugcgcugcguguguagagauaacuggaaggggagcaaccggcccaucgucgacauuaaugugaaggauuacucuaucguuuccagcuaugugugcucuggacuggucggcgacaccccgcgcaaaaacgacagcuccucuagcuccuacugucucaauccuaacaaugaagagggcgggcacggagugaagggcugggcuuucgaugacgggaacgauguuuggaugggaagaacaauuagcgagaaacugcggucuggcuaugaaaccuuuaaggugaucgggggaugguccaaacccaauagcaagcugcagaucaaccgccaggucauuguggacagaggcaaucggucuggcuacuccgggaucuucagcgucgagggaaaauccugcgugaacagauguuuuuauguugaacucauucgcggccggaagcaggagacggaagugugguggacaucuaauagcaucgucguguucugcgggaccuccggaaccuacggcacagggucuuggccugauggcgccgacauuaaccugaugcccaucuga

SEQ ID NO: 198125 - RNA, 1410 nt, Artificial Sequence
  derived and/or modified sequence opt5 from neuraminidase__InfluenzaA__ABG26937
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaacccuaauaacgaaaaggggagccacggagugaaaggcugggcuuucgaugacgggaaugauguuuggaugggacggacaauuucugaggagcuccgcuccggcuaugaaaccuuuaaggugaucgggggauggagcaaacccaacucuaagcugcagaucaauagacaggucauuguggaccggggcaacagauccggcuacagcgggaucuucuccgucgagggaaaaucuugcauuaaucgcuguuuuuauguggaacugauccggggcagaaagcaggagacggaaguuugguggacaagcaacuccauuguggucuucugcgggaccucuggaaccuacggcacagggagcuggccugauggcgccgacaucaaucucaugcccauuuga

SEQ ID NO: 198126 - RNA, 1413 nt, Artificial Sequence; identical to SEQ ID NO: 197420
  derived and/or modified sequence opt5 from neuraminidase__InfluenzaA__ABG26948

SEQ ID NO: 198127 - RNA, 1410 nt, Artificial Sequence; identical to SEQ ID NO: 197190
  derived and/or modified sequence opt5 from neuraminidase__InfluenzaA__ABG26959

SEQ ID NO: 198128 - RNA, 1413 nt, Artificial Sequence
  derived and/or modified sequence opt5 from neuraminidase__InfluenzaA__ABG37123
augaaccccaaucagaagaucauuaccaucggcagcauuuccaucacaauugggaucaucucucugaugcuccaaauuggaaacaucauuagcaucugggccucccacucuauucagacgggcagccagaaucauaccggggugugcaaccagagaaucauuacauacgaaaauuccaccugggucaaccacacauauguuaauaucaacaauaccaacgugaucgcuggaaaagacaagacaucugugacccuggccggcaauagcucccuuuguagcauuucugggugggcgaucuacacgaaagauaacuccauucggaucggaagcaagggcgacgucuucgugauucgcgagccuuuuaucucuugcucccaucuggaguguagaaccuucuuucucacacaaggcgcucugcuuaaugauaaacacagcaacgggaccguuaaggaccggucuccguaucgcgcccugauguccugcccccucggagaagccccuagccccuacaauuccaaguucgagucuguggcuuggagcgccuccgcuugucaugauggcaugggguggcugacaaucggaauuagcggcccugacaacggggccgucgcggugcugaaauauaacggaaucauuaccgaaacgaucaagucuuggaaaaagcagauucucagaacacaggaguccgagugcguuugugugaauggcagcugcuuuaccaucaugacagauggccccucuaacggggccgcuagcuacaaaaucuucaagauugaaaagggaaaagucaccaaguccaucgagcugaaugccccuaacuuucacuaugaagaguguucuugcuacccggacaccggcacagugaugugugugugccgggauaauuggcacgggagcaaccgccccugggucuccuucaaucagaaccuugacuaccaaauuggauauaucugcagcggcguuuuuggggauaauccuagacccaaagacggagagggcucuuguaacccugugacgguggauggcgcuaauggggucaagggauucuccuacaaauauggcaacgggguguggauuggacggaccaagagcaaucgccugagaaaaggcuuugaaaugaucugggaccccaacggguggacagacaccgauucugacuucuccguuaagcaggauguggucgccauuacagacuggagcggcuacuccggaucuuuugugcagcauccggagcucaccggccuggauugcauccggccuuguuucuggguugaacuugugcgcgggcugcccaaggagaauacgacaaucuggaccagcggauccucuauuagcuucugcggcgucaacuccgacaccgcgaacuggagcuggccugauggggccgaacuccccuuuacaaucgacaaauga

SEQ ID NO: 198129 - RNA, 1410 nt, Artificial Sequence
  derived and/or modified sequence opt5 from neuraminidase__InfluenzaA__ABG37134
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagccaacuucugggcuccgcccagcauguugaggaaugcucuuguuauccucgguaccccggggugcgcugcguguguagagacaauuggaagggaagcaaccggccuaucgucgauauuaacgugaaagacuacuccaucguuagcucuuaugugugcuccggccucgucggcgacacaccccgcaagaaugauagcucuagcuccucucacugucugaacccgaauaacgaggaagggggacauggcgugaaagggugggcuuucgacgauggaaaugacguuuggaugggcagaaccauuagcgagaagcugcgguccggguacgagaccuuuaaagugaucgaaggauggagcaagccuaacucuaaacuccagaucaaucgccaggucauuguggauagaggcaaccgguccggcuauagcgggaucuucucugucgagggaaaguccugcauuaauagauguuuuuacguggaacugauccgcggccggaagcaagagacggaaguuugguggacaagcaacuccauuguggucuucugcgggaccucuggaaccuauggcacagggagcuggcccgacggcgccgauaucaaucuuaugccuauuuga

SEQ ID NO: 198130 - RNA, 1410 nt, Artificial Sequence; identical to SEQ ID NO: 197150
  derived and/or modified sequence opt5 from neuraminidase__InfluenzaA__ABG37145

SEQ ID NO: 198131 - RNA, 1410 nt, Artificial Sequence
  derived and/or modified sequence opt5 from neuraminidase__InfluenzaA__ABG37156
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccggcagagcggacacaaagauucuguuuaucgaggaaggaaaaaucguccacauuagcccucuuuccgggucugcccaacauguugaggaaugcagcuguuauccccgguacccuggagugcgcugcguguguagagauaacuggaagggcuccaaccggcccaucgucgacauuaaugugaaggauuacagcaucguuucuaacuaugugugcuccggccuggucggggacaccccgcgcaaaaaugacagcucuagcuccucucacugucucaacccuaauaacgaggaaggaggccauggggugaagggaugggcuuucgaugacggcaaugauguuuggauggggagaacaauuagcgagaaacugcgguccggauacgagaccuuuaaggugaucggcggcuggagcaaacccaacucuaagcugcagaucaaucgccaggucauuguggacagagggaaccgguccggauauagcggcaucuucucugucgaagggaaauccugcauuaauagauguuuuuacguggagcucauccgcggacggaagcaggaaacggagguuugguggacaagcaacuccauuguggucuucugcggcaccucugggaccuauggcacaggaagcuggccugauggcgccgacaucaaucugaugcccauuuga

SEQ ID NO: 198132 - RNA, 1410 nt, Artificial Sequence
  derived and/or modified sequence opt5 from neuraminidase__InfluenzaA__ABG37167
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucucuuccuggagcaaaaacauucuccgcacccaggaaucugagugcgucuguaucaaugggacaugcacgguggugaugaccgacggauccgccagcggcagagcggauacaaagauucuguuuaucgaggaagggaaaaucguccacauuuccccucuuucuggaagcgcccaacauguugaggaaugcuccuguuauccccgguacccuggcgugcgcugcguguguagagacaacuggaaggggagcaaccggcccaucgucgauauuaaugugaaggacuacucuaucguuuccagcuaugugugcucuggacuggucggcgacaccccgcgcaaaaacgauagcuccucuagcuccuacugucucaauccuaacaaugaggaaggcgggcacggagugaagggcugggcuuucgacgaugggaacgacguuuggaugggaagaacaauuagcgagaaacugcggucuggcuaugagaccuuuaaggugaucgggggaugguccaaacccaauagcaagcugcagaucaaccgccaggucauuguggauagaggcaaucggucuggcuacuccgggaucuucagcgucgaaggaaaauccugcgugaacagauguuuuuauguugagcucauucgcggccggaagcaggaaacggaggugugguggacaucuaauagcaucgucguguucugcgggaccuccggaaccuacggcacagggucuuggccugacggcgccgauauuaaccugaugcccaucuga

SEQ ID NO: 198133 - RNA, 1410 nt, Artificial Sequence
  derived and/or modified sequence opt5 from neuraminidase__InfluenzaA__ABG37189
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugcugcucugcgaacccacaaucauugagagaaauaucaccgaaauuguguaucugacaaacaccacgaucgagaaggaaauuuguccuaaacuugccgaguaccggaauuggagcaagccccagugcaaaaucaccggguucgcgccuuuuuccaaggacaacucuauucgccugagcgcuggaggcgauaucugggucacaagagagcccuauguguccugugacccugggaagugcuaccaauucgcccucggacagggcaccacacugaauaaccggcauucuaaugauaccguucacgaccgcacgccguauagaacacugcucaugaacgaacugggggugcccuuucaucuuggaaccaaacaggucuguaucgccuggagcuccagcucuugccacgauggcaaggcuuggcugcauguguguguuacaggccacgacgagaaugccaccgcuuccuucauuuacgaugggcggcucguggacagcaucggaucuugguccaaaaacauucugcgcacccaggaaagcgagugcgucuguaucaauggcacaugcacgguggugaugaccgaugggucugccuccggcagagcggacacaaagauucuuuuuaucgaggaaggaaaaaucguccacauuagcucccugucugggagcgcccaacauguugaggaaugcuccuguuauccucgguaccccggagugcgcugcguguguagagauaacuggaagggcagcaaccggccuaucgucgacauuaaugugaaggauuacucuaucguuuccagcuaugugugcucuggccucgucggggacacaccccgcaaaaacgacagcuccucuagcucccacugucugaauccgaacaaugaggaaggaggccauggggugaagggaugggcuuucgaugacggcaacgauguuuggauggggagaaccauuagcgagaaacugcggucuggauacgagaccuuuaaggugaucggcggcugguccaaaccuaauagcaagcuccagaucaaccgccaggucauuguggacagagggaaucggucuggauauuccggcaucuucagcgucgaagggaaauccugcauuaacagauguuuuuacguggagcugauccgcggacggaagcaggaaacggagguuugguggacaucuaauagcauuguggucuucugcggcaccuccgggaccuauggcacaggaucuuggcccgauggcgccgacaucaaccuuaugccuauuuga

SEQ ID NO: 198134 - RNA, 1410 nt, Artificial Sequence
  derived and/or modified sequence opt5 from neuraminidase__InfluenzaA__ABG37200
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacucugggaagugcuaccaauucgcccugggacagggcaccacacucaauaaccggcauagcaaugauaccguucacgaccgcacgccuuauagaacacugcugaugaacgaacucggggugccguuucaucugggaaccaaacaggucuguaucgccugguccucuagcuccugccacgauggcaaggcuuggcuucauguguguguuacaggccacgacgagaaugccaccgcuagcuucauuuacgaugggcggcugguggacucuaucggauccuggagcaaaaacauucuccgcacccaggaaucugagugcgucuguaucaauggcacaugcacgguggugaugaccgauggguccgccagcggcagagcggacacaaagauucuguuuaucgaggaaggaaaaaucguccacauuuccacccuuucugggagcgcccaacauguugaggaaugcuccuguuauccccgguacccuggagugcgcugcguguguagagauaacuggaagggcagcaaccggcccaucgucgacauuaaugugaaggauuacucuaucguuuccagcuaugugugcucuggccuggucggggacacaccucgcaaaaacgacagcuccucuagcucccacugucucaaucccaacaaugaggaaggaggccauggggugaagggaugggcuuucgaugacggcaacgauguuuggauggggagaaccauuagcgagaaacugcggucuggauacgagacguuuaaggugaucggcggcugguccaaaccgaauagcaagcugcagaucaaccgccaggucauuguggacagagggaaucggucuggauauuccggcaucuucagcgucgaagggaaauccugcauuaacagauguuuuuacguggagcucauccgcggacggaagcaggaaacagagguuugguggaccucuaauagcauuguggucuucugcggcaccuccgggacauauggcaccggaucuuggccugauggcgccgacaucaaccugaugcccauuuga

SEQ ID NO: 198135 - RNA, 1410 nt, Artificial Sequence
  derived and/or modified sequence opt5 from neuraminidase__InfluenzaA__ABG37211
augaaccccaaucagaagaucauuaccaucggcagcgugucccugacaauugccacgaucugcuuccucacccaaauugcuauccuggucacaaccguuacacuucacuuuaaacaguacgaguguucuagcccuccgaacaaucaggugaugcccugcgaaccuaucauuaucgagagaaacauuaccgaaaucguguaucugacaaauaccacgauugagaaggaaaucugucccaaacucgucgaguaccggaacugguccaagccucagugcaaaauuaccggguucgcccccuuuucuaaggacaauagcauccgccuguccgcgggaggcgauaucugggugacaagagagccuuauguuucuugugacccggggaagugcuaccaauucgcucuuggacagggcaccacacugaacaauaaacauagcaacgauaccauucacgaccggacgcccuaucgcacacuccugaugaaugaacugggggugccuuuucaucucggaaccaagcaggucuguaucgccugguccuccucuuccugccacgauggcaaagccuggcugcauguguguauuacaggccacgacaagaacgcuaccgccagcuucaucuacgaugggagacuuguugacucuauuggauccuggagcaaaaauauccugcggacccaggagucugaaugcguguguaucaacggcacaugcacggucgugaugaccgauggguccgcuagcgagcgcgccgacacaaagauucucuuuaucgaggaaggaaagauugugcacaucagcccccugucuggcagcgcgcaacaugucgaggaaugcuccuguuauccuagauaccccgggguucggugcgugugucgcgauaauuggaaaggaagcaacagaccgauuguggacaucaacgucaaggauuacucuaucguguccagcuauguuugcucuggccuugugggcgacaccccucggaaaaaugaccgcagcuccucuagcuacuguagaaaccccaauaacgagaaggggaaucacggagucaaaggcugggccuucgaugacgggaacgauguguggaugggacggacaauuggcgaggaacugcgcuccggguaugagaccuuuaagguuaucggaggcuggagcacgccuaauucuaaacuccagauuaacagacaggugaucgucgacuccggcaaucggagcggguacucuggaauuuucuccguggaaggcaagagcugcaucaacagauguuuuuaugucgagcugauucgcgggcgggaacaggagacaagagugugguggaccuccaauucuaucguuguguucugcggaaccagcggcacauacgggaccggcuccuggcccgauggagcugacaucaaccugaugcccauuuga

SEQ ID NO: 198136 - RNA, 1410 nt, Artificial Sequence
  derived and/or modified sequence opt5 from neuraminidase__InfluenzaA__ABG37233
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggccaugcugugcgaacccacaaucauugagagaaacaucaccgaaauuguguaucucacaaauaccacgaucgagaaggaaauuuguccuaaacuggcggaguaccggaacugguccaagccccagugcaaaaucaccggguucgcuccuuuuucuaaggacaauagcauucgccuuuccgccggaggcgauaucugggugacaagagagcccuaugucucuugugacccugggaagugcuaccaauucgcccugggacagggcaccacaaucaacaaucggcauagcaacgauaccgugcacgaccgcacgccguauagaacacuccugaugaaugaacuggggguucccuuucaucucggaaccaaacagguguguauugcuugguccucuagcuccugccacgauggcaaggccuggcugcaugucugugugacaggccacgacgagaacgcuaccgccagcuucaucuacgaugggcggcuuguugacucuauuggauccuggagcaaaaauauccugcgcacccaggaaucugagugcguguguauuaacggcacaugcacggucgugaugaccgauggguccgcgagcggcagagccgacacaaagauccucuuuaucgaggaaggaaaaauugugcacaucuccccucugucugggagcgcucaacaugucgaggaaugcuccuguuauccccgguacccuggaguucgcugcguguguagagauaauuggaagggcagcaaccggcccauuguggacaucaacgucaaggauuacucuauuguguccagcuauguuugcucuggccuugugggggacaccccgcgcaaaaaugacagcuccucuaacagcuacuguagaaauccuaacaaugagaagggaucccacggcgucaaagggugggccuucgaugacggaaacgauguguggaugggccggacaaucagcgcugaaucucgcuccggguaugagaccuuuaagguuaucggaggcuggagcaaacccaauucuaagcugcagauuaacagacaggugaucgucgaccggggcaauagauccggguacagcggaauuuucuccguggagggcaaaucuugcaucaaccgcuguuuuuaugucgaacucauucgggggagaaagcaggagacggaagugugguggacaagcaauuccaucguuguguucugcggaaccucuggcaccuacgggacaggcagcuggccugauggagccgacauuaaccugaugcccaucuga

SEQ ID NO: 198137 - RNA, 1410 nt, Artificial Sequence
  derived and/or modified sequence opt5 from neuraminidase__InfluenzaA__ABG37244
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgacagagcggauacaaagauucuguuuaucgaggaaggaaaaaucguccacauuagcccucuuuccggcucugcccaacauguugaggaaugcagcuguuauccccgguacccuggggugcgcugcguguguagagacaacuggaagggauccaaccggcccaucgucgauauuaaugugaaggacuacagcaucguuucuuccuaugugugcagcggccuggucggcgacaccccgcgcaaaaacgauucuagcuccucuagcuacuguuggaauccuaacaaugagaaagggggacacggcgugaaggggugggcuuucgacgauggaaacgacguuuggaugggcagaacaauuuccgaagagagccggucuggguaugagaccuuuaaggugaucggaggcugguccaaacccaauagcaagcuccagaucaaccgccaggucauuguggauagaggcaaucggucuggguacuccggaaucuucagcgucgaaggcaaauccugcauuaacagauguuuuuauguggagcugauccgcgggcggaagcaggaaacggagguuugguggacaucuaauagcauuguggucuucugcggaaccuccggcaccuacgggacaggcucuuggccugacggagccgauaucaaccugaugcccauuuga

SEQ ID NO: 198138 - RNA, 1410 nt, Artificial Sequence; identical to SEQ ID NO: 198137
  derived and/or modified sequence opt5 from neuraminidase__InfluenzaA__ABG37255

SEQ ID NO: 198139 - RNA, 1410 nt, Artificial Sequence; identical to SEQ ID NO: 198124
  derived and/or modified sequence opt5 from neuraminidase__InfluenzaA__ABG37266

SEQ ID NO: 198140 - RNA, 1410 nt, Artificial Sequence; identical to SEQ ID NO: 198137
  derived and/or modified sequence opt5 from neuraminidase__InfluenzaA__ABG37277

SEQ ID NO: 198141 - RNA, 1410 nt, Artificial Sequence; identical to SEQ ID NO: 198137
  derived and/or modified sequence opt5 from neuraminidase__InfluenzaA__ABG37288

SEQ ID NO: 198142 - RNA, 1410 nt, Artificial Sequence; identical to SEQ ID NO: 198137
  derived and/or modified sequence opt5 from neuraminidase__InfluenzaA__ABG37310

SEQ ID NO: 198143 - RNA, 1410 nt, Artificial Sequence; identical to SEQ ID NO: 198124
  derived and/or modified sequence opt5 from neuraminidase__InfluenzaA__ABG37321

SEQ ID NO: 198144 - RNA, 1410 nt, Artificial Sequence
  derived and/or modified sequence opt5 from neuraminidase__InfluenzaA__ABG37332
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauugugcaccucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucacguguguguuacaggccaugacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgacagagcggauacaaagauucuguuuaucgaggaaggaaaaaucguccacauuagcccucuuuccggcggggcccaacauguugaggaaugcucuuguuauccccgguacccuggagugcgcugcguguguagagacaacuggaagggcagcaaccggcccaucgucgauauuaaugugaaggacuauuccaucguuagcucuuacgugugcuccggccuggucggggacaccccgcgcaaaaacgauagcucuagcuccucuuacuguuggaauccuaacaaugagaagggaggccacggggugaaaggaugggcuuucgacgauggcaacgacguuuggauggggagaacaauuagcgaagagucccggagcggauaugagaccuuuaaggugaucggcggcuggucuaaacccaauuccaagcuccagaucaaccgccaggucauuguggauagagggaaucggagcggauacucuggcaucuucuccgucgaagggaaaagcugcauuaacagauguuuuuauguggagcugauccgcggacggaagcaggaaacggagguuugguggacauccaauucuauuguggucuucugcggcaccagcgggaccuacggcacaggauccuggccugacggcgccgauaucaaccugaugcccauuuga

SEQ ID NO: 198145 - RNA, 1410 nt, Artificial Sequence
  derived and/or modified sequence opt5 from neuraminidase__InfluenzaA__ABG37343
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgacagagcggauacaaagauucuguuuaucgaggaaggaaaaaucguccacauuagcccucuuuccggcucugcccaacauguugaggaaugcagcuguuauccccgguacccuggggugcgcugcguguguagagacaacuggaagggauccaaccggcccaucgucgauauuaaugugaagaacuacagcaucguuucuuccuaugugugcagcggccuggucggcgacaccccgcgcaaaaaugacucuagcuccucuagcuacuguuggaacccuaauaacgagaaagggggacacggcgugaaggggugggcuuucgaugacggaaaugauguuuggaugggcagaacaauuuccgaagagagccggucuggguaugagaccuuuaaggugaucggaggcugguccaaacccaacagcaagcuccagaucaaucgccaggucauuguggacagaggcaaccggucuggguacuccggaaucuucagcgucgaaggcaaauccugcauuaauagauguuuuuauguggagcugauccgcgggcggaagcaggaaacggagguuugguggacaucuaacagcauuguggucuucugcggaaccuccggcaccuacgggacaggcucuuggccugauggagccgacaucaaucugaugcccauuuga

SEQ ID NO: 198146 - RNA, 1410 nt, Artificial Sequence; identical to SEQ ID NO: 198125
  derived and/or modified sequence opt5 from neuraminidase__InfluenzaA__ABG37354

SEQ ID NO: 198147 - RNA, 1413 nt, Artificial Sequence; identical to SEQ ID NO: 197852
  derived and/or modified sequence opt5 from neuraminidase__InfluenzaA__ABG37365

SEQ ID NO: 198148 - RNA, 1413 nt, Artificial Sequence; identical to SEQ ID NO: 197954
  derived and/or modified sequence opt5 from neuraminidase__InfluenzaA__ABG37387

SEQ ID NO: 198149 - RNA, 1413 nt, Artificial Sequence
  derived and/or modified sequence opt5 from neuraminidase__InfluenzaA__ABG37398
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauaacacaugggucaaucacaccuauguuaacaucaauaacacaaaugugaucgccggaaaagacaagaccuccgugacacuggcgggcaacucuagccuuuguuccauuagcgggugggcuaucuacaccaaagauaauucuauucggaucggauccaagggcgacgucuucgugauucgcgaaccuuuuaucagcugcucucaucuggaguguagaacguucuuucucacccaaggcgcccugcuuaacgauaaacacuccaaugggacaguuaaggaccggagcccguaucgcgcccugaugucuugcccccucggagaagcuccuucccccuacaacagcaaguucgaguccguggccuggucugcuagcgccugucaugauggcaugggguggcugaccaucggaauuuccggcccugacaacggggcggucgccgugcugaaauauaauggaaucauuacagaaaccaucaagagcuggaaaaagcagauucucagaacgcaggagucugagugcguuugugugaacggcuccugcuuuacaaucaugaccgauggccccagcaauggggcugccucuuacaaaaucuucaagauugaaaagggaaaagucacaaagagcaucgagcugaacgcuccuaauuuucacuaugaagaguguuccugcuacccggacaccggcaccgugaugugugugugccgggauaacuggcacgggucuaaucgccccugggucagcuucaaccagaaucuugacuaccaaauuggauauaucugcuccggcguuuuuggggauaacccuagacccaaagacggagagggcagcuguaauccugugacaguggauggcgccaacggggucaagggauucucuuacaaauauggcaaugggguguggauuggacggacgaaguccaaccgccugagaaaaggcuuugaaaugaucugggaccccaauggguggaccgacacagauagcgacuucucuguuaagcaggauguggucgcgauuaccgacugguccggcuacagcggauccuuugugcagcauccggagcucacaggccuggauugcauccggccuuguuucuggguugaacuugugcgcgggcugcccaaggagaacaccacgaucuggacaucuggaagcuccauuucuuucugcggcgucaacagcgacaccgccaauugguccuggccugauggggcugaacuccccuuuaccaucgacaaauga

SEQ ID NO: 198150 - RNA, 1410 nt, Artificial Sequence
  derived and/or modified sequence opt5 from neuraminidase__InfluenzaA__ABG37409
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcccugcgaaccuacaaucauugagagaaauaucaccgaaauugucuaucugacaaacaccacgaucgagaaggaaauuugucccaaacucgcugaguaccggaauuggagcaagccucagugcaacaucaccggguucgcccccuuuuccaaagacaauucuauucgccugagcgcgggaggcgauaucugggugacaagagagccuuauguuuccugugacccggauaagugcuaccaauucgcucuugggcagggaaccacacugaacaauggccauucuaacgacaccgugcacgaucggacgcccuaucgcacacuccugaugaaugaacugggggucccuuuucaucucggaaccaaacagguguguaucgccuggagcuccagcucuugccacgacggcaaggccuggcugcauguuugugugacaggcgaugacgagaacgcuaccgccuccuucauuuacaaugggagacuugucgauagcaucggaucuugguccaagaaaauucugcggacccaggaaagcgagugcguguguaucaacggcacaugcacgguggucaugaccgacgggucugcuuccggaaaggccgauacaaaaauucucuuuaucgaggaaggcaagaucguucacaccagccugcuuuccgggucugcgcaacacguggaggaaugcagcuguuauccccgcuacccuggagugagaugcgucugucgggacaacuggaagggcuccaaucgccccauuguggauaucaacguuaaagacuacagcauugugucuuccuaugucugcagcggccuggugggggacacaccgagaaagaaugauucuagcuccucuagccauugucucgacccuaacaaugaggaaggaggccacgggguuaaaggaugggccuucgaugaccggaacgauguguggaugggccgcaccaucuccgagaagcugagaagcggguacgagacguuuaaagucauugaaggauggucuaagcccaauuccaaacugcagaucaaccgccaggugaucgucgaccggggcaauagaagcggcuauucugggauuuucuccguggagggaaagagcugcaucaaccgguguuuuuacguugaacucauuagaggccgcaagcaggagacagaagugcuguggaccuccaauucuaucgucguguucugcgggaccagcggaacauauggcaccggguccuggccugauggcgcugacauuaaccuuaugcccaucuga

SEQ ID NO: 198151 - RNA, 1410 nt, Artificial Sequence
  derived and/or modified sequence opt5 from neuraminidase__InfluenzaA__ABG37442
augaaccccaaucagaagaucauuaccaucggcagcgugucccugacaauugccacgaucugcuuccucaugcaaauugcuauccuggucaccacaguuacccuucacuuuaaacaguucgaguguaacucuccuccgaauaaccaggugaugcugugcgaacccacaaucauugaggggaauaucaccgaaauuguguaccucacaaacaccacgaucgagaaggaaauuuguccuaaacuggccgaguauagaaauuggagcaagccccagugcaacaucaccggauuugcgccuuucuccaaagacaauucuauucggcuuagcgcuggcggggauaucugggucacacgcgagcccuacguguccugugacccugauaagugcuaucaauuugcccugggacagggcaccacacucaacaaugggcauucuaacgacaccguucacgauagaacgccguaccggacacugcugaugaaugaacucggagugcccuuccaucugggcacccgccaggucuguaucgccuggagcuccagcucuugccacgacggcaaggcuuggcuucauguguguguuacaggggaugacgagaacgccaccgcuuccuuuauuuauaauggaagacugguggauagcaucggcucuugguccaaaaagauucuccggacccaggaaagcgagugcgucuguaucaacgggacaugcacgguggugaugaccgacggaucugccuccggcaaagcggauacaaagauucuguucaucgaggaagggaaaaucguccacauuagcacccuuuccggaucugcccaacacguugaggaaugcagcuguuacccucgcuaucccggcgugagaugcgugugucgggacaacuggaagggcuccaaucgcccuaucgucgauauuaacgugaaggacuacagcaucguuucuuccuacgugugcagcgggcuggucggagacacaccccggaaaaaugauucuuuuagcuccucucauugucucgacccgaacaaugaggaaggcgggcacggagugaagggcugggcuuucgaugacgggaacgauguuuggaugggaagaaccauuagcgagaaacugcgcuccggcuaugagacguuuaaggugaucgaaggcuggagcaaaccuaauucuaagcugcagacaaacagacaggucaucguggagcgggggaaucgcuccggauacagcggcauuuucucugucgaagggaaauccugcaucaacagauguuuuuauguggagcucauucggggaagaaaggaagagaccgagguuugguggaccagcaauuccaucguggucuucugcggcacaucugggaccuacggcacaggaagcuggcccgacggcgccgauauuaaccugaugccuaucuga

SEQ ID NO: 198152 - RNA, 1410 nt, Artificial Sequence; identical to SEQ ID NO: 197178
  derived and/or modified sequence opt5 from neuraminidase__InfluenzaA__ABG37453

SEQ ID NO: 198153 - RNA, 1410 nt, Artificial Sequence; identical to SEQ ID NO: 197190
  derived and/or modified sequence opt5 from neuraminidase__InfluenzaA__ABG37464

SEQ ID NO: 198154 - RNA, 1410 nt, Artificial Sequence
  derived and/or modified sequence opt5 from neuraminidase__InfluenzaA__ABG37475
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuagcgagaaacugagauccggauacgagacguucaaggugaucgaaggcuggagcaaaccuaauucuaagcugcagaucaaccggcaggucauuguggagcgcggcgacagauccggguauagcggaaucuuuucugucgaaggcaaauccugcauuaaucgguguuucuacguggagcucaucagagggcgcaaggaagagacagagguucuguggaccagcaacuccauuguggucuuuugcggaaccucuggcacauaugggaccggcagcuggcccgauggagccgacaucaaucuuaugccuauuuga

SEQ ID NO: 198155 - RNA, 1410 nt, Artificial Sequence
  derived and/or modified sequence opt5 from neuraminidase__InfluenzaA__ABG37486
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaccuuaccggguucgcgccuuuuuccaaagacaauucuauccgccugagcgcuggaggcgauauuugggucacaagagagcccuauguguccugugacccugauaagugcuaccaauucgcccucgggcagggaaccacacugaacaauggccauucuaacgacaccguucacgaucggacgccguaucgcacacugcucaugaaugaacugggggugcccuuucaucuuggaaccagacaggucuguaucgccuggagcuccagcucuugccacgacggcaaggcuuggcugcauguguguguuacaggcgaugacgagaacgccaccgcuuccuucaucuacaaugggcggcucguggauagcauuggaucuugguccaaaaagauccugcgcacccaggaaagcgagugcgucuguauuaacggcacaugcacgguggugaugaccgacgggucugccuccggaaaagcggauacaaagauccuuuuuauugaggaaggcaaaaucguccacaucagcacccuguccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccucgucggggacacaccccggaaaaaugauucuuucagcuccucucauugucuggacccgaacaaugaggaaggaggccacggggugaagggaugggcuuuugaugacggcaacgauguuuggauggggcgcaccaucagcgagaaacugagauccggauacgagacguucaaggugauugaaggcuggagcaaaccuaauucuaagcuccagacaaaccggcaggucaucguggagcgcggcaauagauccggguauagcggaaucuuuucugucgaaggcaaauccugcauuaaccgguguuucuacguggagcugaucagagggcgcaaggaagagaccgagguuugguggaccagcaauuccauuguggucuuuugcggaacaucuggcaccuaugggacaggcagcuggcccgacggagccgauaucaaccuuaugccuauuuga

SEQ ID NO: 198156 - RNA, 1410 nt, Artificial Sequence
  derived and/or modified sequence opt5 from neuraminidase__InfluenzaA__ABG37497
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauuaucuuuaucgaggaaggcaaaauuguccacaucagcacccuguccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuugucggggacacaccccggaaaaaugauucuuucagcuccucucauugucuggacccgaacaaugaggaaggaggccacggggugaagggaugggcuuuugaugacggcaacgauguuuggauggggcgcaccaucagcgagaaacucagauccggauacgagacguucaaggugaucgaaggcuggagcaaaccuaauucuaagcugcagacaaaccggcaggucauuguggagcgcggcaauagauccggguauagcggaaucuuuucugucgaaggcaaauccugcauuaaccgguguuucuacguggagcugaucagagggcgcaaggaagagaccgagguuugguggaccagcaauuccauuguggucuuuugcggaacaucuggcaccuaugggacaggcagcuggcccgacggagccgauaucaaccucaugccuauuuga

SEQ ID NO: 198157 - RNA, 1410 nt, Artificial Sequence; identical to SEQ ID NO: 197204
  derived and/or modified sequence opt5 from neuraminidase__InfluenzaA__ABG37508

SEQ ID NO: 198158 - RNA, 1410 nt, Artificial Sequence; identical to SEQ ID NO: 197615
  derived and/or modified sequence opt5 from neuraminidase__InfluenzaA__ABG37519

SEQ ID NO: 198159 - RNA, 1410 nt, Artificial Sequence; identical to SEQ ID NO: 197615
  derived and/or modified sequence opt5 from neuraminidase__InfluenzaA__ABG37530

SEQ ID NO: 198160 - RNA, 1410 nt, Artificial Sequence; identical to SEQ ID NO: 197615
  derived and/or modified sequence opt5 from neuraminidase__InfluenzaA__ABG37541

SEQ ID NO: 198161 - RNA, 1410 nt, Artificial Sequence; identical to SEQ ID NO: 197615
  derived and/or modified sequence opt5 from neuraminidase__InfluenzaA__ABG37552

SEQ ID NO: 198162 - RNA, 1410 nt, Artificial Sequence; identical to SEQ ID NO: 197615
  derived and/or modified sequence opt5 from neuraminidase__InfluenzaA__ABG37563

SEQ ID NO: 198163 - RNA, 1410 nt, Artificial Sequence; identical to SEQ ID NO: 197615
  derived and/or modified sequence opt5 from neuraminidase__InfluenzaA__ABG37585

SEQ ID NO: 198164 - RNA, 1410 nt, Artificial Sequence; identical to SEQ ID NO: 197615
  derived and/or modified sequence opt5 from neuraminidase__InfluenzaA__ABG37596

SEQ ID NO: 198165 - RNA, 1410 nt, Artificial Sequence; identical to SEQ ID NO: 197615
  derived and/or modified sequence opt5 from neuraminidase__InfluenzaA__ABG37607

SEQ ID NO: 198166 - RNA, 1410 nt, Artificial Sequence; identical to SEQ ID NO: 197615
  derived and/or modified sequence opt5 from neuraminidase__InfluenzaA__ABG37618

SEQ ID NO: 198167 - RNA, 1413 nt, Artificial Sequence; identical to SEQ ID NO: 197852
  derived and/or modified sequence opt5 from neuraminidase__InfluenzaA__ABG47810

SEQ ID NO: 198168 - RNA, 1413 nt, Artificial Sequence
  derived and/or modified sequence opt5 from neuraminidase__InfluenzaA__ABG47832
augaaccccaaucagaagaucauuaccaucggcagcauuuccaucgccauugggaucaucucucugauucuccaagugggaaacaucauuagcaucugggcuucccacucuauucagacaggcagccagaaucauacggggaucugcaaccagagaauuaucaccuacgagaauagcacaugggugaaccaaaccuauguuaauaucaacaauacaaacgugguggccggaaaagacaagaccucuaugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggccugggguggcugaccaucggaauuagcggccccgacaacggggcggucgccgugcucaaguauaacggaaucauuacagaaaccaucaaauccuggaagaaacgcauucugagaacgcaggagagcgagugcguuuguaugaauggcucuugcuuuacaaucaugaccgauggcccuuccaacggggcugccagcuaccggaucuucaagauugaaaaaggacgcgugacaaagucuaucgagcuugacgcuccgaauuaucauuacgaagaguguagcugcuaccccaacaccggcaccgucaugugugugugcagagauaauuggcacggguccaaccggccuugggugucuuuuaaucagaaccuggacuaucaaauuggauacaucugcagcggcgucuucggggauaauccccgcccuaaggacggagagggcuccuguaaccccguuacaguggauggcgccgacggggugaaaggauuuagcuauagauacggcaauggggucuggauuggacggacgaagucuaaccgccucagaaaaggcuucgaaaugaucugggacccgaauggguggaccgauacagacuccgauuuuagcaugaagcaggacauuguggcgaugaccgauuggucuggcuauuccggauccuucguucagcacccugagcugacaggccuugacugcaugcggcccuguuuuuggguggaacuggucagagggcucccucgcgagaacaccacgaucuggacauccggaucuagcaucuccuucugcggcgucaauucugauaccgccaacuggagcuggcccgacggggcugaacugcccuucaccauugauaaauga

SEQ ID NO: 198169 - RNA, 1413 nt, Artificial Sequence; identical to SEQ ID NO: 197992
  derived and/or modified sequence opt5 from neuraminidase__InfluenzaA__ABG47843

SEQ ID NO: 198170 - RNA, 1410 nt, Artificial Sequence
  derived and/or modified sequence opt5 from neuraminidase__InfluenzaA__ABG47865
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugauaagugcuaccaauucgcccuggggcagggaacaacccucaauaaccggcauucuaaugacacaguucacgaucgcaccccguauagaacgcugcugaugaacgaacucggcgugcccuuucaucuggggacaaaacaggucuguauugccuggagcuccagcucuugccacgacggaaaggcuuggcuucauguguguguuaccggccacgaugagaaugccacagcuuccuucaucuacgacggccggcugguggauagcauugggucuugguccaaaaagauccuccgcacccaggaaagcgagugcgucuguauuaacggaaccugcacaguggugaugacggacggcucugccuccgggagagcggauaccaaaauccuguuuaucgaggaaggaaagauuguccacaucagcccucuuuccggcucugcccaacauguugaggaaugcagcuguuauccccgguacuccggggugcgcugcguguguagagacaauuggaagggaagcaaccggccuauugucgauaucaacgugaaagacuacucuauuguuuccagcuaugugugcucuggccuggucggcgacacaccccgcaagaaugauagcuccucuagcucccacugucucaacccgaauaacgaggaagggggacauggcgugaaagggugggcuuucgacgauggaaaugacguuuggaugggcagaaccaucagcgagaagcugcggucuggguacgagacauuuaaagugaucggaggcugguccaagccuaacagcaaacugcagauuaaucgccaggucaucguggauagaggcaaccggucuggguauuccggaauuuucagcgucgaaggcaaguccugcaucaauagauguuuuuacguggagcucauucgcgggcggaagcaggaaaccgagguuugguggacgucuaacagcaucguggucuucugcggaacauccggcaccuaugggaccggcucuuggcccgacggagccgauauuaaucugaugccuaucuga

SEQ ID NO: 198171 - RNA, 1410 nt, Artificial Sequence; identical to SEQ ID NO: 198137
  derived and/or modified sequence opt5 from neuraminidase__InfluenzaA__ABG47876

SEQ ID NO: 198172 - RNA, 1410 nt, Artificial Sequence; identical to SEQ ID NO: 198137
  derived and/or modified sequence opt5 from neuraminidase__InfluenzaA__ABG47887

SEQ ID NO: 198173 - RNA, 1410 nt, Artificial Sequence; identical to SEQ ID NO: 198124
  derived and/or modified sequence opt5 from neuraminidase__InfluenzaA__ABG47898

SEQ ID NO: 198174 - RNA, 1410 nt, Artificial Sequence; identical to SEQ ID NO: 198137
  derived and/or modified sequence opt5 from neuraminidase__InfluenzaA__ABG47909

SEQ ID NO: 198175 - RNA, 1410 nt, Artificial Sequence; identical to SEQ ID NO: 198125
  derived and/or modified sequence opt5 from neuraminidase__InfluenzaA__ABG47920

SEQ ID NO: 198176 - RNA, 1410 nt, Artificial Sequence; identical to SEQ ID NO: 198125
  derived and/or modified sequence opt5 from neuraminidase__InfluenzaA__ABG47931

SEQ ID NO: 198177 - RNA, 1410 nt, Artificial Sequence; identical to SEQ ID NO: 198125
  derived and/or modified sequence opt5 from neuraminidase__InfluenzaA__ABG47942

SEQ ID NO: 198178 - RNA, 1410 nt, Artificial Sequence
  derived and/or modified sequence opt5 from neuraminidase__InfluenzaA__ABG47953
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaacccuaauaacgaaaaggggagccacggagugaaaggcugggcuuucgaugacgggaaugauguuuggaugggacggacaauuucugaggagcuccgcuccggcuaugaaaccuuuaaggugaucgggggauggagcaaacccaacucuaagcugcagaucaauagacaggucauuguggaccggggcaacagauccggcuacagcgggaucuucuccgucgagggaaaaucuugcauuaaucgcuguuuuuauguggaacugauccggggcagaaagcaggagacggaaguuugguggacaagcaacuccauuguggucuucugcgggaccucuggaaccuacggcacagggagcuggccugauggcgccaauaucaaccucaugcccauuuga

SEQ ID NO: 198179 - RNA, 1410 nt, Artificial Sequence
  derived and/or modified sequence opt5 from neuraminidase__InfluenzaA__ABG47964
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacugucagaauccuaacaaugaaaaggggucccacggagugaaaggcugggcuuucgaugacgggaacgauguuuggaugggaagaacaauuagcgaggagcuccggucuggcuaugaaaccuuuaaggugaucgggggaugguccaaacccaauagcaagcugcagaucaaccgccaggucauuguggacagaggcaaucggucuggcuacuccgggaucuucagcgucgagggaaaauccugcauuaacagauguuuuuauguggaacugauccgcggccggaagcaagagacggaaguuugguggacaucuaauagcauuguggucuucugcgggaccuccggaaccuacggcacagggucuuggccugauggcgccgacaucaaccucaugcccauuuga

SEQ ID NO: 198180 - RNA, 1410 nt, Artificial Sequence
  derived and/or modified sequence opt5 from neuraminidase__InfluenzaA__ABG47975
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagagauccuaacaaugaacgggggagccacggagugaagggcugggcuuucgacgaugggaacgacguuuggaugggacgcacaauuucugaggagcucagauccggcuaugaaaccuuuaaagugaucgggggauggagcaagcccaauucuaaacugcagaucaaccggcaggucauuguggauagaggcaaucgcuccggcuacagcgggaucuucuccgucgagggaaagucuugcauuaaccgguguuuuuauguggaacugaucagaggccgcaaacaggagacggaaguuugguggacaagcaauuccauuguggucuucugcgggaccucuggaaccuacggcacagggagcuggccugacggcgccgauaucaaccucaugcccauuuga

SEQ ID NO: 198181 - RNA, 1410 nt, Artificial Sequence
  derived and/or modified sequence opt5 from neuraminidase__InfluenzaA__ABG47986
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaagccuaacaaugaaaaagggagccacggagugaagggcugggcuuucgaugacgggaacgauguuuggaugggacggacaauuucugaggagcuccgcuccggcuaugaaaccuuuaaagugaucgggggauggagcaagcccaauucuaaacugcagaucaacagacaggucauuguggaccggggcaauagauccggcuacagcgggaucuucuccgucgagggaaagucuugcauuaaccgcuguuuuuauguggaacugauccggggcagaaagcaggagacggaaguuugguggacaagcaauuccauuguggucuucugcgggaccucuggaaccuacggcacagggagcuggccugauggcgccgacaucaaccucaugcccauuuga

SEQ ID NO: 198182 - RNA, 1410 nt, Artificial Sequence; identical to SEQ ID NO: 198125
  derived and/or modified sequence opt5 from neuraminidase__InfluenzaA__ABG47997

SEQ ID NO: 198183 - RNA, 1410 nt, Artificial Sequence
  derived and/or modified sequence opt5 from neuraminidase__InfluenzaA__ABG48008
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcagaaaugacagcuccucuagcuccuacugucggaaaccuaacaaugaaaaggggagccacggagugaaaggcugggcuuucgaugacgggaacgauguuuggaugggacgcacaauuucugaggagcucagauccggcuaugaaaccuuuaaggugaucgggggauggagcaaacccaauucuaagcugcagaucaaccggcaggucauuguggacagaggcaaucgcuccggcuacagcgggaucuucuccgucgagggaaaaucuugcauuaaccgguguuuuuauguggaacugaucagaggccgcaagcaggagacggaaguuugguggacaagcaauuccauuguggucuucugcgggaccucuggaaccuacggcacagggagcuggccugauggcgccgacaucaaccucaugcccauuuga

SEQ ID NO: 198184 - RNA, 1410 nt, Artificial Sequence
  derived and/or modified sequence opt5 from neuraminidase__InfluenzaA__ABG48019
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcgcuuguagagauaauuggaagggaagcaaccggcccaucguggacauuaacgucaaggauuacucuaucguguccagcuauguuugcucuggccuggugggcgacaccccgcgcaaaaaugacagcuccucuagcuccuacuguagaaacccuaauaacgaaaaggggagccacggagucaaaggcugggccuucgaugacgggaaugauguguggaugggacggacaauuucugaggagcuccgcuccggcuaugaaaccuuuaagguuaucgggggauggagcaaacccaacucuaagcugcagaucaauagacaggugauugucgaccgggauaacagauccggcuacagcggcaucuucuccguggaggggaaaucuugcauuaaucgcuguuuuuaugucgaacugauccggggaagaaagcaggagacggaagugugguggacaagcaacuccauuguuguguucugcggcaccucugggaccuacggaacaggcagcuggccugacggggcugauaucaaucucaugcccauuuga

SEQ ID NO: 198185 - RNA, 1410 nt, Artificial Sequence; identical to SEQ ID NO: 198125
  derived and/or modified sequence opt5 from neuraminidase__InfluenzaA__ABG48030

SEQ ID NO: 198186 - RNA, 1410 nt, Artificial Sequence; identical to SEQ ID NO: 198125
  derived and/or modified sequence opt5 from neuraminidase__InfluenzaA__ABG48041

SEQ ID NO: 198187 - RNA, 1413 nt, Artificial Sequence; identical to SEQ ID NO: 197852
  derived and/or modified sequence opt5 from neuraminidase__InfluenzaA__ABG48052

SEQ ID NO: 198188 - RNA, 1410 nt, Artificial Sequence; identical to SEQ ID NO: 197754
  derived and/or modified sequence opt5 from neuraminidase__InfluenzaA__ABG48063

SEQ ID NO: 198189 - RNA, 1410 nt, Artificial Sequence; identical to SEQ ID NO: 197877
  derived and/or modified sequence opt5 from neuraminidase__InfluenzaA__ABG48074

SEQ ID NO: 198190 - RNA, 1410 nt, Artificial Sequence; identical to SEQ ID NO: 197178
  derived and/or modified sequence opt5 from neuraminidase__InfluenzaA__ABG48085

SEQ ID NO: 198191 - RNA, 1410 nt, Artificial Sequence
  derived and/or modified sequence opt5 from neuraminidase__InfluenzaA__ABG48107
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagacccuccgcacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacauucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccugaugccuaucuga

SEQ ID NO: 198192 - RNA, 1410 nt, Artificial Sequence; identical to SEQ ID NO: 197190
  derived and/or modified sequence opt5 from neuraminidase__InfluenzaA__ABG48118

SEQ ID NO: 198193 - RNA, 1410 nt, Artificial Sequence; identical to SEQ ID NO: 197190
  derived and/or modified sequence opt5 from neuraminidase__InfluenzaA__ABG48129

SEQ ID NO: 198194 - RNA, 1410 nt, Artificial Sequence; identical to SEQ ID NO: 197178
  derived and/or modified sequence opt5 from neuraminidase__InfluenzaA__ABG48140

SEQ ID NO: 198195 - RNA, 1410 nt, Artificial Sequence; identical to SEQ ID NO: 197190
  derived and/or modified sequence opt5 from neuraminidase__InfluenzaA__ABG48151

SEQ ID NO: 198196 - RNA, 1410 nt, Artificial Sequence; identical to SEQ ID NO: 197178
  derived and/or modified sequence opt5 from neuraminidase__InfluenzaA__ABG48173

SEQ ID NO: 198197 - RNA, 1410 nt, Artificial Sequence; identical to SEQ ID NO: 197190
  derived and/or modified sequence opt5 from neuraminidase__InfluenzaA__ABG48184

SEQ ID NO: 198198 - RNA, 1410 nt, Artificial Sequence
  derived and/or modified sequence opt5 from neuraminidase__InfluenzaA__ABG48195
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauuguauugacccgaacaaugaggaaggaggccacggggugaagggaugggcuuuugaugacggcaacgauguuuggauggggcgcaccaucagcgagaaacucagauccggauacgagacguucaaggugaucgaaggcuggagcaaaccuaauucuaagcugcagacaaaccggcaggucauuguggagcgcggcaauagauccggguauagcggaaucuuuucugucgaaggcaaauccugcauuaaccgguguuucuacguggagcugaucagagggcgcaaggaagagaccgagguuugguggaccagcaauuccauuguggucuuuugcggaacaucuggcaccuaugggacaggcagcuggcccgacggagccgauaucaaccucaugccuauuuga

SEQ ID NO: 198199 - RNA, 1410 nt, Artificial Sequence
  derived and/or modified sequence opt5 from neuraminidase__InfluenzaA__ABG48206
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuaaugaaaagcugagaagcggauaugagacguucaaagucaucgagggcugguccaagccuaacagcaaacugcagaucaaucgccaggugauugucgaacggggcaacagaucuggguacuccggaaucuuuagcguggagggcaagucuugcauuaaucgguguuucuauguugaacucaucagagggcgcaaggaggaaacagaggugugguggaccuccaacagcauugucguguuuugcggaaccuccggcacauacgggaccggcucuuggcccgacggagcugauaucaaucugaugccuauuuga

SEQ ID NO: 198200 - RNA, 1410 nt, Artificial Sequence; identical to SEQ ID NO: 197615
  derived and/or modified sequence opt5 from neuraminidase__InfluenzaA__ABG48217

SEQ ID NO: 198201 - RNA, 1410 nt, Artificial Sequence; identical to SEQ ID NO: 197615
  derived and/or modified sequence opt5 from neuraminidase__InfluenzaA__ABG48228

SEQ ID NO: 198202 - RNA, 1410 nt, Artificial Sequence; identical to SEQ ID NO: 198199
  derived and/or modified sequence opt5 from neuraminidase__InfluenzaA__ABG48239

SEQ ID NO: 198203 - RNA, 1410 nt, Artificial Sequence; identical to SEQ ID NO: 197615
  derived and/or modified sequence opt5 from neuraminidase__InfluenzaA__ABG48250

SEQ ID NO: 198204 - RNA, 1410 nt, Artificial Sequence
  derived and/or modified sequence opt5 from neuraminidase__InfluenzaA__ABG48272
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaaucucgcuccggcuacgagacauuuaaggugaucgagggguggagcaacccuaauucuaaacuccagauuaacagacaggucaucguggaucggggaaaucgcuccggcuauagcggcauuuucuccgucgaagggaagucuuguaucaacagaugcuuuuacguggagcugauucggggaagaaaggaagagaccgaaguucuguggaccagcaauuccaucguggucuucuguggcacaucugggaccuauggaacaggcagcuggcccgacggggcugauauuaaccucaugccuaucuga

SEQ ID NO: 198205 - RNA, 1410 nt, Artificial Sequence
  derived and/or modified sequence opt5 from neuraminidase__InfluenzaA__ABG48294
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugauccccugccagccuacaauuaucgaaagaaacauuaccgagaucguguaucugacaaauaccacgauugaaaaggagaucugucccaaacucgucgaauaccggaacugguccaagccucaaugcaaaauuaccggguucgcccccuuuucuaaggacaauagcauccgccuguccgcgggaggcgauaucugggugacaagagagccuuauguuucuugugacccggggaagugcuaccaguucgcucuuggacagggcaccacacugaacaaucggcauagcaacgauaccgugcacgaccgcacgcccuauagaacacuccugaugaaugagcugggggucccuuuucaucucggaaccaaacagguguguauugccugguccuccucuuccugccacgauggcaaggccuggcugcauguuugugugacaggccacgacgaaaacgcuaccgccagcuucaucuacgaugggcggcuugucgacucuauuggauccuggagccgcaauauccugagaacccaagagucugaaugcguguguauuaacggcacaugcacgguggucaugaccgauggguccgcuagcgagcgggccgacacaaaaauccucuuuaucgaggaaggaaagguugugcacauuagcccccugucuggcagcgcgcagcauguggaggaaugcuccuguuauccucgcuaccccggggucagaugcgugugucgggauaauuggaaaggaagcaaccgcccgaucguugacauuaacgugaaggauuacucuaucauuuccagcuaugucugcucuggccuugugggcgacaccccuagacggaaugacagcuccucuagcuccuacugucagaaccccaauaacgagaaggggagccacggaguuaaaggcugggccuucgaugacgggaaugauguguggaugggacgcacaaucucugaggaacugagauccggcuaugagaccuuuaaggucaucgggggauggagcacgccuaacucuaaacuccagauuaaucggcaagugaucgucgacuccggcaacagaagcggcuacuccgggauuuucucuguggaaggaaagagcugcaucaaucgcuguuuuuauguugagcugauucggggcagaaaacaggaaacaaaggugugguggaccuccaacucuaucgucguguucugcgggaccagcggaacauacggcaccggguccuggcccgauggcgcugacauugaucugaugcccaucuga

SEQ ID NO: 198206 - RNA, 1410 nt, Artificial Sequence
  derived and/or modified sequence opt5 from neuraminidase__InfluenzaA__ABG48305
augaaccccaaucagaagaucauuaucauuggcagcgugucccugaccaucgccacaauuugcuuccucaugcaaaucgcuauccuggucacgaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaaaauuacgggguucgcgccuuuuuccaaggacaacucuauccgccuuagcgcuggaggcgauaucugggucaccagagagcccuauguguccugugacccugggaagugcuaccaauucgcccugggacagggcacaacccucaauaaccggcauucuaaugauacaguucacgaccgcaccccguauagaacgcugcugaugaacgaacucggggugcccuuucaucugggaacaaaacaggucuguauugccuggagcuccagcucuugccacgauggcaaggcuuggcuucauguguguguuaccggccacgacgagaaugccacagcuuccuucaucuacgaugggcggcugguggacagcauuggaucuugguccaaaaacauccuccgcacccaggaaagcgagugcgucuguauuaaugggaccugcacaguggugaugacggauggcucugccuccgagagagcggacaccaagauccuguuuaucgaagagggaaaaauuguccacaucagcccucuuuccggcucugcccaacauguugaagagugcagcuguuauccccgguacccuggggugcgcugcguguguagagauaacuggaagggauccaaccggcccauugucgacaucaaugugaaggauuacagcauuguuucuuccuaugugugcagcggccuggucggcgacacaccgcgcaaaaacgacucuagcuccucuagcuacuguagaaauccuaacaaugaaaaggggucccacggagugaaaggcugggcuuucgaugacgggaacgauguuuggaugggacggaccaucagcgaggagcuccgcucuggcuaugaaacauuuaaggugaucgggggaugguccaaacccaauagcaagcugcagauuaacagacaggucaucguggaccggggcaauagaucuggcuacuccgggauuuucagcgucgagggaaaauccugcaucaaccgcuguuuuuauguggaacugauucggggcagaaagcaggagaccgaaguuugguggacgucuaauagcaucguggucuucugcgggacauccggaaccuacggcaccgggucuuggccugauggcgccgacauuaaccucaugcccaucuga

SEQ ID NO: 198207 - RNA, 1410 nt, Artificial Sequence
  derived and/or modified sequence opt5 from neuraminidase__InfluenzaA__ABG48316
augaaccccaaucagaagaucauuaccaucggcagcgugucccugacagucgccacgauuugcuuccucaugcaaaucgcuauucugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauauuugggugacaagagagcccuauguuuccugugacccugggaagugcuaccaauucgcccugggacagggcaccacacucaauaaccggcauucuaaugauaccgugcacgaccgcacgccguauagaacacugcugaugaacgaacucgggguccccuuucaucugggaaccaaacagguguguaucgccuggagcuccagcucuugccacgauggcaaggcuuggcuucauguuugugugacaggccacgacgagaaugccaccgcuuccuucaucuacgaugggcggcuggucgacagcauuggaucuugguccaaaaacauccuccgcacccaggaaagcgagugcguguguauuaauggcacaugcacgguggucaugaccgaugggucugccuccgagagagcggacacaaagauccuguuuauugaagagggaaaaaucguucacaucagcccucuuuccggcucugcccaacauguggaagagugcagcuguuauccccgguacccuggggugcgcugcgucuguagagauaacuggaagggauccaaccggcccauuguggacaucaauguuaaggauuacagcauugugucuuccuaugucugcagcggccuggugggcgacaccccgcgcaaaaacgacucuagcuccucuagcuacuguagaaauccuaacaaugaaaaggggucccacggaguuaaaggcugggcuuucgaugacgggaacgauguguggaugggacggacaaucagcgaggagcuccgcucuggcuaugaaaccuuuaaggucauugggggaugguccaaacccaauagcaagcugcagaucaacagacaggugaucgucgagcggggcaauagaucuggcuacuccgggauuuucagcguggaaggaaaauccugcaucaaccgcuguuuuuauguugagcugauucggggcagaaagcaggaaacggaggugugguggacaucuaauagcaucgucguguucugcgggaccuccggaaccuacggcacagggucuuggccugacggcgccgauauuaaccucaugcccaucuga

SEQ ID NO: 198208 - RNA, 1410 nt, Artificial Sequence
  derived and/or modified sequence opt5 from neuraminidase__InfluenzaA__ABG48327
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccggggagugaaaggcugggcuuucgaugacgggaacgauguuuggaugggacgcacaauuagcgaggagcucagaucuggcuaugaaaccuuuaaggugaucgggggaugguccaaacccaauagcaagcugcagaucaaccggcaggucauuguggacagaggcaaucgcucuggcuacuccgggaucuucagcgucgagggaaaauccugcauuaaccgguguuuuuauguggaacugaucagaggccgcaagcaggagacggaaguuugguggacaucuaauagcauuguggucuucugcgggaccuccggaaccuacggcacagggucuuggccugauggcgccgacaucaaccucaugcccauuuga

SEQ ID NO: 198209 - RNA, 1410 nt, Artificial Sequence
  derived and/or modified sequence opt5 from neuraminidase__InfluenzaA__ABG48338
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuagcgaggagcuccgcucuggcuaugaaaccuuuaaggugaucgggggaugguccaaacccaauagcaagcugcagaucaacagacaggucauuguggaccggggcaauagaucuggcuacuccgggaucuucagcgucgagggaaaauccugcauuaaccgcuguuuuuauguggaacugauccggggcagaaagcaggagacggaaguuugguggacaucuaauagcauuguggucuucugcgggaccuccggaaccuacggcacagggucuuggccugauggcgccgacaucaaccucaugcccauuuga

SEQ ID NO: 198210 - RNA, 1410 nt, Artificial Sequence; identical to SEQ ID NO: 198209
  derived and/or modified sequence opt5 from neuraminidase__InfluenzaA__ABG48349

SEQ ID NO: 198211 - RNA, 1410 nt, Artificial Sequence
  derived and/or modified sequence opt5 from neuraminidase__InfluenzaA__ABG48360
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugagcgaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggaaacugguggacucuaucggauccuggagcaagaauauucuccggacccaggaaucugagugcgucuguaucaacggcacaugcacgguggugaugaccgauggguccgccagcgagcgcgcggacacaaaaauucuguuuaucgaagagggaaagaucguccacauuuccccucuuucuggcagcgcccaacauguugaagagugcuccuguuaucccagauacccuggggugcggugcgugugucgcgauaauuggaagggaagcaacagacccaucgucgacauuaacgugaaagaucacucuaucguuuccagcuacgugugcucuggccuggucggcgacaccccgcggaagaaugacagcuccucuagcuccuauugucgcaacccuaauaacgaaaaagggagccauggagugaagggcugggcuuucgaugacgggaaugauguuuggaugggaagaacaauuucugaggagcuccgguccggcuacgaaaccuuuaaagugaucgggggauggagcaagcccaacucuaaacugcagaucaaucgccaggucauuguggacagaggcaaccgguccggcuauagcgggaucuucuccgucgagggaaagucuugcauuaauagauguuuuuacguggaacugauccgcggccggaagcaggagacggaaguuugguggacaagcaacuccauuguggucuucugcgggaccucuggaaccuauggcacagggagcuggccugauggcgccgacaucaaucucaugcccauuuga

SEQ ID NO: 198212 - RNA, 1410 nt, Artificial Sequence; identical to SEQ ID NO: 198209
  derived and/or modified sequence opt5 from neuraminidase__InfluenzaA__ABG48371

SEQ ID NO: 198213 - RNA, 1410 nt, Artificial Sequence
  derived and/or modified sequence opt5 from neuraminidase__InfluenzaA__ABG67138
augaaccccaaucagaagaucauuaccaucggcagcgugucccugacaauugccacgaucugcuuccucacccaaauugcuauccuggucacaaccguuacacuucacuuuaaacaguacgaguguaacucuccuccgagcaaucaggugaugcugugcgaacccaccacaaucgagagaaacauuaccgaaaucguguaucucacgaauaccacaauugagaaggaaaucuguccuaaacuggccgaguaccggaacugguccaagccccagugcaaaauuaccggguucgcgccuuuuucuaaggacaauagcauccgccuuuccgcuggaggcgauauuugggucacaagagagcccuaugugucuugugacccugauaagugcuaccaauucgcccuggggcagggaaccacgcucaacaaucggcauagcaacgacacaguucacgaucgcaccccguauagaacacugcugaugaaugaacucggcgugcccuuucaucuggggaccaaacaggucuguaucgccugguccucuagcuccugccacgacggaaaggcuuggcuucauguguguguuaccggccacgaugagaacgccacagcuagcuucaucuacgacggccggcugguggauucuauuggguccuggagcaaaaagauccuccgcacgcaggaaucugagugcgucuguauuaauggaaccugcacaguggugaugaccgacggcuccgccagcgggagagcggauacaaaaauccuguuuauugaggaaggaaagaucguccacaucuccccucuuucuggcagcgcccaacauguugaggaaugcuccuguuauccccgguacccuggggugcgcugcguguguagagacaacuggaagggaagcaaucggcccauugucgauaucaacgugaaagacuacucuauuguuuccagcuaugugugcucuggccuggucggcgacaccccgcgcaagaacgauagcuccucuagcucccacugucucaauccuaacaaugaggaagggggacauggcgugaaagggugggcuuucgacgauggaaacgacguuuggaugggcagaacgaucagcgagaagcugcggucuggguacgagacauuuaaagugauugaaggaugguccaagcccaauagcaaacugcagaucaaccgccaggucaucguggauagaggcaaucggucuggcuauuccgggauuuucagcgucgagggaaaguccugcaucaacagauguuuuuacguggaacucauucgcggccggaagcaggagaccgaaguuugguggaccucuaauagcaucguggucuucugcgggacauccggaaccuauggcacagggucuuggccugacggcgccgauauuaaccugaugcccaucuga

SEQ ID NO: 198214 - RNA, 1410 nt, Artificial Sequence; identical to SEQ ID NO: 197150
  derived and/or modified sequence opt5 from neuraminidase__InfluenzaA__ABG67149

SEQ ID NO: 198215 - RNA, 1410 nt, Artificial Sequence
  derived and/or modified sequence opt5 from neuraminidase__InfluenzaA__ABG67160
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggagcugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucugugugaacggcacaugcacgguggucaugaccgauggguccgccagcgagagagcggacacaaagauccuguuuauugaagagggaaaaaucguucacaucuccccucuuucuggcagcgcccaacauguggaagagugcuccuguuauccccgguacccuggggugcgcugcgucuguagagauaauuggaagggaagcaaccggcccauuguggacaucaacguuaaggauuacucuauuguguccagcuaugucugcucuggccuggugggcgacaccccgcgcaaaaaugacagcuccucuagcuccuacuguuggaacccuaauaacgaaaaagggggacacggcguuaaggggugggcuuucgaugacggaaaugauguguggaugggcagaacaaucagcgaggagcuccggucuggguaugaaaccuuuaaggucauuggaggcugguccaaacccaacagcaagcugcagaucaaucgccaggugaucgucgacagaggcaaccggucuggguacuccggaauuuucagcguggagggcaaauccugcaucaauagauguuuuuauguugaacugauucgcgggcggaagcaggagacggaagugugguggacaucuaacagcaucgucguguucugcggaaccuccggcaccuacgggacaggcucuuggccugauggagccgacauuaaucucaugcccaucuga

SEQ ID NO: 198216 - RNA, 1410 nt, Artificial Sequence
  derived and/or modified sequence opt5 from neuraminidase__InfluenzaA__ABG67171
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacaaaaaugccaccgcuuccuucauuuacgaugggcggcugguggacagcaucggaucuugguccaagaacauucuccgcacccaggagagcgaaugcgucuguaucaauggcacaugcacgguggugaugaccgaugggucugccuccgacagagcggauacaaaaauucuguuuaucgaggagggaaagaucguccacauuagcccucuuuccggcucugcccaacauguugaagagugcagcuguuauccccgguacccuggggugcgcugcguguguagagacaacuggaagggauccaaccggcccaucgucgauauuaaugugaaagacuacagcaucguuucuuccuaugugugcagcggccuggucggcgacaccccgcgcaagaacgauucuagcuccucuagcuacuguuggaauccuaacaaugaaaaagggggacacggcgugaaggggugggcuuucgacgauggaaacgacguuuggaugggcagaacaauuuccgaggaaagccggucuggguaugagaccuuuaaagugaucggaggcugguccaagcccaauagcaaacuccagaucaaccgccaggucauuguggauagaggcaaucggucuggguacuccggaaucuucagcgucgagggcaaguccugcauuaacagauguuuuuauguggaacugauccgcgggcggaagcaggagacggaaguuugguggacaucuaauagcauuguggucuucugcggaaccuccggcaccuacgggacaggcucuuggccugacggagccgauaucaaccugaugcccauuuga

SEQ ID NO: 198217 - RNA, 1410 nt, Artificial Sequence; identical to SEQ ID NO: 198137
  derived and/or modified sequence opt5 from neuraminidase__InfluenzaA__ABG67182

SEQ ID NO: 198218 - RNA, 1410 nt, Artificial Sequence
  derived and/or modified sequence opt5 from neuraminidase__InfluenzaA__ABG67193
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaccaucgagagaaauauuacagaaaucguguaucucaccaacacgaccauugagaaggaaaucuguccuaaacuggccgaguaccggaauuggagcaagccccagugcaaaauuacaggguucgcgccuuuuuccaaggacaacucuauccgccuuagcgcuggaggcgauauuugggucaccagagagcccuauguguccugugacccugggaagugcuaccaauucgcccugggacagggcacaacccucaauaaccggcauucuaaugauacgguucacgaccgcacaccguauagaacccugcugaugaacgaacucggggugcccuuucaucugggaacaaaacaggucuguaucgccuggagcuccagcucuugccacgauggcaaggcuuggcuucauguguguguuaccggccacgacgagaaugccaccgcuuccuucaucuacgaugggcggcugguggacagcauuggaucuugguccaaaaacauccuccgcacacaggaaagcgagugcgucuguauuaauggcacgugcaccguggugaugacagaugggucugccuccgacagagcggauaccaagauccuguuuauugaggaaggaaaaaucguccacaucagcccucuuuccggcucugcccaacauguugaggaaugcagcuguuauccccgguacccuggggugcgcugcguguguagagacaacuggaagggauccaaccggcccauugucgauaucaaugugaagaacuacagcauuguuucuuccuaugugugcagcggccuggucggcgacacaccgcgcaaaaaugacucuagcuccucuagcuacuguuggaacccuaauaacgagaaagggggacacggcgugaaggggugggcuuucgaugacggaaaugauguuuggaugggcagaaccaucuccgaagagagccggucuggguaugagacguuuaaggugauuggaggcugguccaaacccaacagcaagcuccagaucaaucgccaggucaucguggacagaggcaaccggucuggguacuccggaauuuucagcgucgaaggcaaauccugcaucaauagauguuuuuauguggagcugauucgcgggcggaagcaggaaacagagguuugguggaccucuaacagcaucguggucuucugcggaaccuccggcacauacgggaccggcucuuggccugauggagccgacauuaaucugaugcccaucuga

SEQ ID NO: 198219 - RNA, 1410 nt, Artificial Sequence; identical to SEQ ID NO: 198137
  derived and/or modified sequence opt5 from neuraminidase__InfluenzaA__ABG67204

SEQ ID NO: 198220 - RNA, 1410 nt, Artificial Sequence
  derived and/or modified sequence opt5 from neuraminidase__InfluenzaA__ABG67215
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugggccuggaaagugcuaccaauucgcccugggccaggggaccacacucaacaaucggcauagcaacgacaccguucacgaucgcacgccguauagaacacugcugaugaaugaacucggagugcccuuucaucugggcaccaaacaggucuguaucgccugguccucuagcuccugccacgacggcaaggcuuggcuucauguguguguuacagggcacgaugagaacgccaccgcuagcuucauuuacgacggacggcugguggauucuaucggcuccuggagcaaaaauauucuccgcacccaggaaucugagugcgucuguaucaacgggacaugcacgguggugaugaccgacggauccgccagcgagagagcggauacaaagauucuguuuaucgaagagggcaaaaucguccacauuuccccucuuucugggagcgcccaacauguugaagagugcuccuguuauccccgguacccuggagugcgcugcguguguagagacaauuggaagggcagcaaccggcccaucgucgauauuaacgugaaggacuacucuaucguuuccagcuaugugugcucuggccuggucggggauaccccgcgcaaaaaugacagcuccucuagcuccuacuguagaaacccuaauaacgaaaagggaagccacggcgugaaagggugggcuuucgacgauggaaaugacguuuggaugggccggacaauuucugaggagcuccgcuccggguaugaaaccuuuaaggugaucggaggcuggagcaaacccaacucuaagcugcagaucaauagacaggucauuguggaucggggcaacagauccggguacagcggaaucuucuccgucgagggcaaaucuugcauuaaucgcuguuuuuauguggaacugauccgggggagaaagcaggagacggaaguuugguggacaagcaacuccauuguggucuucugcggaaccucuggcaccuacgggacaggcagcuggccugacggagccgauaucaaucucaugcccauuuga

SEQ ID NO: 198221 - RNA, 1410 nt, Artificial Sequence; identical to SEQ ID NO: 198125
  derived and/or modified sequence opt5 from neuraminidase__InfluenzaA__ABG67226

SEQ ID NO: 198222 - RNA, 1410 nt, Artificial Sequence; identical to SEQ ID NO: 198125
  derived and/or modified sequence opt5 from neuraminidase__InfluenzaA__ABG67248

SEQ ID NO: 198223 - RNA, 1413 nt, Artificial Sequence; identical to SEQ ID NO: 197852
  derived and/or modified sequence opt5 from neuraminidase__InfluenzaA__ABG67480

SEQ ID NO: 198224 - RNA, 1413 nt, Artificial Sequence; identical to SEQ ID NO: 197420
  derived and/or modified sequence opt5 from neuraminidase__InfluenzaA__ABG67494

SEQ ID NO: 198225 - RNA, 1410 nt, Artificial Sequence; identical to SEQ ID NO: 197178
  derived and/or modified sequence opt5 from neuraminidase__InfluenzaA__ABG67505

SEQ ID NO: 198226 - RNA, 1410 nt, Artificial Sequence; identical to SEQ ID NO: 197178
  derived and/or modified sequence opt5 from neuraminidase__InfluenzaA__ABG67516

SEQ ID NO: 198227 - RNA, 1410 nt, Artificial Sequence; identical to SEQ ID NO: 198191
  derived and/or modified sequence opt5 from neuraminidase__InfluenzaA__ABG67527

SEQ ID NO: 198228 - RNA, 1410 nt, Artificial Sequence
  derived and/or modified sequence opt5 from neuraminidase__InfluenzaA__ABG67538
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaccaucgagagaaauacaaccgaaauuguguaucucacgaacaccacaaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacgcucaacaauggccauucuaacgacacaguucacgaucggaccccguaucgcacacugcugaugaaugaacucggggugcccuuucaucugggaaccagacaggucuguauugccuggagcuccagcucuugccacgacggcaaggcuuggcuucauguguguguuaccggcgaugacgagaacgccacagcuuccuucaucuacaaugggcggcugguggauagcaucggaucuugguccaaaaagauucuccgcacgcaggaaagcgagugcgucuguaucaacgggaccugcacaguggugaugaccgacggcucugccuccggaaaagcggauacaaagauucuguuuaucgaggaaggcaaaauuguccacaucagcacccuuuccgggucugcccaacacguugaggaaugcagcuguuauccuagauaccccggagugcggugcgugugucgcgacaacuggaagggcuccaauagaccuaucauugauaucaacgucaaggacuacagcauugugucuuccuauguuugcagcggccuggugggggacacgccccggaaaaaugauucuuucagcuccucucauugucucgacccgaacaaugaggaaggaggccacggggucaagggaugggcuuuugaugacggcaacgauguguggauggggcgcacaaucagcgagaaacugagauccggauacgagaccuucaagguuauugaaggcuggagcaaaccuaauucuaagcugcagaccaaccgccaggugaucgucgagcggggcaauagauccggguauagcggaaucuuuucuguggaaggcaaauccugcauuaaccgguguuucuacgucgagcucaucagagggcgcaaggaagagacagaggugugguggaccagcaauuccauuguuguguuuugcggaacaucuggcacguaugggaccggcagcuggcccgacggagccgauaucaaccugaugccuauuuga

SEQ ID NO: 198229 - RNA, 1410 nt, Artificial Sequence
  derived and/or modified sequence opt5 from neuraminidase__InfluenzaA__ABG67549
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaaugauucuuucagcuccucucacugucucgacccgaacaaugaagagggaggccaugggguuaaaggaugggccuuugaugacggcaacgauguguggauggggcgcaccauuagcgaaaagcugagauccggauaugagacguucaaagucaucgagggcuggagcaagccuaauucuaaacugcagaucaaccgccaggugauugucgaacggggcaauagauccggguacagcggaaucuuuucuguggagggcaaguccugcauuaaccgguguuucuauguugaacucaucagagggcgcaaggaggaaaaugaggugugguggacaagcaacuccauugucguguuuugcggaaccucuggcaccuacgggacaggcagcuggcccgacggagcugauaucaaucugaugccuauuuga

SEQ ID NO: 198230 - RNA, 1410 nt, Artificial Sequence; identical to SEQ ID NO: 197615
  derived and/or modified sequence opt5 from neuraminidase__InfluenzaA__ABG67560

SEQ ID NO: 198231 - RNA, 1410 nt, Artificial Sequence; identical to SEQ ID NO: 197615
  derived and/or modified sequence opt5 from neuraminidase__InfluenzaA__ABG67571

SEQ ID NO: 198232 - RNA, 1410 nt, Artificial Sequence
  derived and/or modified sequence opt5 from neuraminidase__InfluenzaA__ABG67582
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgaagcauguggaagagugcagcuguuacccuagauaucccggagugcggugcgucugucgcgacaacuggaaaggcuccaauagaccuaucguggauauuaacguuaaggacuacagcaucgugucuuccuacgucugcagcggccuggugggggacacaccccggaaaaaugauucuuucagcuccucucacugucucgacccgaacaaugaagagggaggccaugggguuaagggaugggccuuugaugacggcaacgauguguggauggggcgcaccauuagcgaaaaacugagauccggauaugagacguucaaggucaucgagggcuggagcaaaccuaauucuaagcugcaaaucaaccgccaggugauugucgaacggggcaauagauccggguacagcggaaucuuuucuguggagggcaaguccugcauuaaccgguguuucuauguugaacucaucagagggcgcaaagaggaaacagaggugugguggaccagcaauuccauugucguguuuugcggaaccucuggcacauacgggaccggcagcuggcccgacggagcugauaucaaccugaugccuauuuga

SEQ ID NO: 198233 - RNA, 1410 nt, Artificial Sequence; identical to SEQ ID NO: 198199
  derived and/or modified sequence opt5 from neuraminidase__InfluenzaA__ABG67593

SEQ ID NO: 198234 - RNA, 1410 nt, Artificial Sequence; identical to SEQ ID NO: 197615
  derived and/or modified sequence opt5 from neuraminidase__InfluenzaA__ABG67604

SEQ ID NO: 198235 - RNA, 1410 nt, Artificial Sequence; identical to SEQ ID NO: 197615
  derived and/or modified sequence opt5 from neuraminidase__InfluenzaA__ABG67615

SEQ ID NO: 198236 - RNA, 1410 nt, Artificial Sequence; identical to SEQ ID NO: 197615
  derived and/or modified sequence opt5 from neuraminidase__InfluenzaA__ABG67626

SEQ ID NO: 198237 - RNA, 1410 nt, Artificial Sequence; identical to SEQ ID NO: 197615
  derived and/or modified sequence opt5 from neuraminidase__InfluenzaA__ABG67637

SEQ ID NO: 198238 - RNA, 1410 nt, Artificial Sequence; identical to SEQ ID NO: 197615
  derived and/or modified sequence opt5 from neuraminidase__InfluenzaA__ABG67648

SEQ ID NO: 198239 - RNA, 1410 nt, Artificial Sequence
  derived and/or modified sequence opt5 from neuraminidase__InfluenzaA__ABG67659
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuucccgcgacaauucuauuagacuuagcgcgggaggcgauaucugggugacacgggagcccuacguuuccugugacccugauaaaugcuaucaauucgcucuggggcagggaaccacacucaacaauggccacucuaacgacaccgugcaugaucgcacgccguacagaacacugcugaugaaugaacucgggguccccuuucaccugggaacccgccagguguguaucgccuggagcuccagcucuugccaugacggcaaggccuggcuucacguuugugugacaggcgaugacaagaacgcuaccgccuccuucauuuauaaugggcggcuggucgauagcaucggaucuugguccaaaaagauucucagaacccaggagagcgaaugcguguguaucaacggcacaugcacgguggucaugaccgacgggucugcuuccggaaaagccgauacaaagauucuguuuaucgaggagggcaaaaucguucacauuagcacccuuuccgggucugcgcaacauguggaagagugcagcuguuacccucgguaucccggagugcgcugcgucuguagagacaacuggaagggcuccaaucggccuaucguggauauuaacguuaaggacuacagcaucgugucuuccuacgucugcagcggccuggugggggacacaccccgcaaaaaugauucuuucagcuccucucacugucucgacccgaacaaugaagagggaggccaugggguuaagggaugggccuuugaugacggcaacgauguguggauggggagaaccauuagcgaaaaacugcgguccggauaugagacguucaaggucaucgagggcuggagcaaaccuaauucuaagcugcagaucaaccgccaggugauugucgaaagaggcaaucgguccggguacagcggaaucuuuucuguggagggcaaauccugcauuaacagauguuucuauguugaacucauccgcgggcggaaggaggaaacagaggugugguggaccagcaauuccauugucguguuuugcggaaccucuggcacauacgggaccggcagcuggcccgacggagcugauaucaaccugaugccuauuuga

SEQ ID NO: 198240 - RNA, 1410 nt, Artificial Sequence
  derived and/or modified sequence opt5 from neuraminidase__InfluenzaA__ABG67670
augaaccccaaucagaagaucauuaccaucggcagcgugucccugacaauugccacgaucugcuuccucaugcaaauugcuauccugaucaccacagucacccuucacuuuaaacaguacgaguguaacucuccuccgaauaaccagguuaugcugugcgaacccacaauuaucgagagaaauauuaccgaaaucguguaucucacaaacaccacgauugagaaggaaaucuguccuaaacuggccgaguaccggaauuggagcaagccccagugcaaaauuaccggguucgcgccuuuuuccaaggacaacucuauccgccuuagcgcuggaggcgauaucugggugacaagagagcccuaugucuccugugacccugggaagugcuaccaauucgcccugggacagggcaccacacucaauaaccggcauucuaaugauaccgugcacgaccgcacgccguauagaacacugcugaugaacgaacucgggguucccuuucaucugggaaccaaacagguguguauugccuggagcuccagcucuugccacgauggcaaggcuuggcuucaugucugugugacaggccacgacgagaaugccaccgcuuccuucaucuacgaugggcggcugguugacagcauuggaucuugguccaaaaacauccuccgcacccaggaaagcgagugcguguguauuaauggcacaugcacggucgugaugaccgaugggucugccuccggcagagcggacacaaagauccuguuuaucgaggaaggaaaaauugugcacaucagcccucuuuccgggucugcccaacaugucgaggaaugcagcuguuauccccgguacccuggaguucgcugcguguguagagauaacuggaagggcuccaaccggcccauuguggacaucaaugucaaggauuacagcauugugucuuccuauguuugcagcggccuggugggggacaccccgcgcaaaaacgacucuagcuccucuagccacugucucaauccuaacaaugaggaaggaggccauggggucaagggaugggcuuucgaugacggcaacgauguguggauggggagaacaaucuccgagaaacugcggagcggauacgagaccuuuaagguuaucggcggcuggucuaaacccaauuccaagcugcagauuaaccgccaggugaucgucgacagagggaaucggagcggauauucuggcauuuucuccguggaagggaaaagcugcaucaacagauguuuuuacgucgagcucauucgcggacggaagcaggaaacggaggugugguggacauccaauucuaucguuguguucugcggcaccagcgggaccuauggcacaggauccuggccugauggcgccgacauuaaccugaugcccaucuga

SEQ ID NO: 198241 - RNA, 1410 nt, Artificial Sequence; identical to SEQ ID NO: 197754
  derived and/or modified sequence opt5 from neuraminidase__InfluenzaA__ABG79944

SEQ ID NO: 198242 - RNA, 1413 nt, Artificial Sequence; identical to SEQ ID NO: 198083
  derived and/or modified sequence opt5 from neuraminidase__InfluenzaA__ABG79955

SEQ ID NO: 198243 - RNA, 1410 nt, Artificial Sequence
  derived and/or modified sequence opt5 from neuraminidase__InfluenzaA__ABG79966
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacugucagaacccuaauaacgaaaaggggagccacggagugaaaggcugggcuuucgaugacgggaaugauguuuggaugggaagaacaauuucugaggagcuccgguccggcuaugaaaccuuuaaggugaucgggggauggagcaaacccaacucuaagcugcagaucaaucgccaggucauuguggacagaggcaaccgguccggcuacagcgggaucuucuccgucgagggaaaaucuugcauuaauagauguuuuuauguggaacugauccgcggccggaagcaagagacggaaguuugguggacaagcaacuccauuguggucuucugcgggaccucuggaaccuacggcacagggagcuggccugauggcgccgacaucaaucucaugcccauuuga

SEQ ID NO: 198244 - RNA, 1410 nt, Artificial Sequence
  derived and/or modified sequence opt5 from neuraminidase__InfluenzaA__ABG79977
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggccaugcugugcgaacccacaaucauugagagaaauaucaccgaaauuguguaucucacaaacaccacgaucgagaaggaaauuuguccuaaacuggcggaguaccggaauuggagcaagccccagugcaaaaucaccggguucgcuccuuuuuccaaggacaacucuauucgccuuagcgccggaggcgauaucugggugacaagagagcccuaugucuccugugacccugggaagugcuaccaauucgcccugggacagggcaccacacucaauaaccggcauucuaaugauaccgugcacgaccgcacgccguauagaacacugcugaugaacgaacucgggguucccuuucaucugggaaccaaacagguguguaucgcuuggagcuccagcucuugccacgauggcaaggccuggcuucaugucugugugacaggccacgacgagaaugcuaccgccuccuucauuuacgaugggcggcugguugacagcaucggaucuugguccaaaaacauucuccgcacccaggaaagcgagugcguguguaucaauggcacaugcacggucgugaugaccgaugggucugcguccgacagagccgauacaaagauucuguuuaucgaggaaggaaaaaucgugcacauuagcccucuuuccggcucugcucaacaugucgaggaaugcagcuguuauccccgguacccugggguucgcugcguguguagagacaacuggaagggauccaaccggcccaucguggauauuaaugucaaggacuacagcaucgugucuuccuauguuugcagcggccuggugggcgacaccccgcgcaaaaacgauucuagcuccucuagcuacuguuggaauccuaacaaugagaaagggggacacggcgucaaggggugggccuucgacgauggaaacgacguguggaugggcagaacaauuuccgaagagagccggucuggguaugagaccuuuaagguuaucggaggcugguccaaacccaauagcaagcuccagaucaaccgccaggugauugucgauagaggcaaucggucuggguacuccggaaucuucagcguggaaggcaaauccugcauuaacagauguuuuuaugucgagcugauccgcgggcggaagcaggaaacggaggugugguggacaucuaauagcauuguuguguucugcggaaccuccggcaccuacgggacaggcucuuggccugacggagcugauaucaaccugaugcccauuuga

SEQ ID NO: 198245 - RNA, 1410 nt, Artificial Sequence; identical to SEQ ID NO: 198137
  derived and/or modified sequence opt5 from neuraminidase__InfluenzaA__ABG79988

SEQ ID NO: 198246 - RNA, 1410 nt, Artificial Sequence; identical to SEQ ID NO: 198137
  derived and/or modified sequence opt5 from neuraminidase__InfluenzaA__ABG79999

SEQ ID NO: 198247 - RNA, 1410 nt, Artificial Sequence
  derived and/or modified sequence opt5 from neuraminidase__InfluenzaA__ABG80010
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggaaaaggcaccacacucaauaaccggcauucuaaugauaccguucacgaccgcacgccguauagaacacugcugaugaacgaacucggggugcccuuucaucugggaaccaagcaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgacagagcggauacaaaaauucuguuuaucgaggaaggaaagaucguccacauuagcccucuuuccggcucugcccagcauguugaggaaugcagcuguuauccccgguacccuggggugcgcugcguguguagagacaacuggaagggauccaaccggcccaucgucgauauuaaugugaaagacuacagcaucguuucuuccuaugugugcagcggccuggucggcgacaccccgcgcaagaacgauucuagcuccucuagcuacuguuggaauccuaacaaugagaaagggggacacggcgugaaggggugggcuuucgacgauggaaacgacguuuggaugggcagaacaauuuccgaagagagccggucuggguaugagaccuuuaaagugaucggaggcugguccaagcccaauagcaaacuccaaaucaaccgccaggucauuguggauagaggcaaucggucuggguacuccggaaucuucagcgucgaaggcaaguccugcauuaacagauguuuuuauguggagcugauccgcgggcggaagcaggaaacggagguuugguggacaucuaauagcauuguggucuucugcggaaccuccggcaccuacgggacaggcucuuggccugacggagccgauaucaaccugaugcccauuuga

SEQ ID NO: 198248 - RNA, 1410 nt, Artificial Sequence; identical to SEQ ID NO: 198137
  derived and/or modified sequence opt5 from neuraminidase__InfluenzaA__ABG80021

SEQ ID NO: 198249 - RNA, 1410 nt, Artificial Sequence
  derived and/or modified sequence opt5 from neuraminidase__InfluenzaA__ABG80032
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccauuaucuacgaugggcggcugguggacagcauuucuuccuggagcaaaaacauccuccgcacccaggaaucugagugcgucuguauuaauggaacaugcacgguggugaugaccgauggcuccgccagcgagagagcggacacaaagauccuguucaucgaagaggggaaaauuguccacaucuccccucuuucuggaagcgcccaacauguugaagagugcuccuguuauccccgguacccuggcgugcgcugcguguguagagauaacuggaaggggagcaaccggcccauugucgacaucaaugugaaggauuacucuauuguuuccagcuaugugugcucuggacuggucggcgacaccccgcgcaaaaacgacagcuccucuagcuccuacugucucaauccuaacaaugaagagggcgggcacggagugaagggcugggcuuuugaugacgggaacgauguuuggaugggaagaacaaucagcgagaaacugcggucuggcuaugaaaccuucaaggugaucgggggaugguccaaacccaauagcaagcugcagauuaaccgccaggucaucguggacagaggcaaucggucuggcuacuccgggauuuuuagcgucgagggaaaauccugcgugaacagauguuucuauguugaacucauccgcggccggaagcaggagacggaagugugguggacaucuaauagcauugucguguuuugcgggaccuccggaaccuacggcacagggucuuggccugauggcgccgacaucaaccugaugcccauuuga

SEQ ID NO: 198250 - RNA, 1410 nt, Artificial Sequence; identical to SEQ ID NO: 198124
  derived and/or modified sequence opt5 from neuraminidase__InfluenzaA__ABG80043

SEQ ID NO: 198251 - RNA, 1410 nt, Artificial Sequence; identical to SEQ ID NO: 198137
  derived and/or modified sequence opt5 from neuraminidase__InfluenzaA__ABG80054

SEQ ID NO: 198252 - RNA, 1410 nt, Artificial Sequence; identical to SEQ ID NO: 198124
  derived and/or modified sequence opt5 from neuraminidase__InfluenzaA__ABG80065

SEQ ID NO: 198253 - RNA, 1410 nt, Artificial Sequence
  derived and/or modified sequence opt5 from neuraminidase__InfluenzaA__ABG80076
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuagcgaggagcuccgcucuggcuaugaaaccuuuaaggugaucgggggaugguccaaacccaauagcaagcugcagaucaacagacaggucauuguggaccggggcaauagaucuggcuacuccgggaucuucagcgucgagggcaaaaacugcauuaaucgcuguuuuuauguggaacugauccggggaagaaagcaggagacggaaguuugguggacauccaacucuauuguggucuucugcgggaccagcggaaccuacggcacaggguccuggccugauggcgccgacaucaaucucaugcccauuuga

SEQ ID NO: 198254 - RNA, 1410 nt, Artificial Sequence
  derived and/or modified sequence opt5 from neuraminidase__InfluenzaA__ABG80087
augaaccccaaucagaagaucauuaccaucggcagcgugucccugacaauugccacgaucugcuuccucaugcaaauugcuguccugguuaccacagugacccuucacuuuaaacaguacgaguguaacucuccuccgagcaaucaggugaugcugugcgaacccacaaucaucgagagaaacauuaccgaaaucgucuaucucacaaauaccacgauugagaaggaaaucuguccuaaacuggccgaguaccggaacugguccaagccccagugcaaaauuaccggguucgcgccuuuuucuaaggacaauagcauccgccuuuccgcuggaggcgauauuugggugacaagagagcccuauguuucuugugacccugggaagugcuaccaauucgcccugggacagggcaccacacucaacaaucggcauagcaacgauaccgugcacgaccgcacgccguauagaacacugcugaugaaugaacucgggguccccuuucaucugggaaccaaacagguguguauggccugguccucuagcuccugccacgauggcaaggcuuggcuucauguuugugugacaggccacgacgagaacgccaccgcuagcuucaucuacgaugggcggcuggucgacucuaucggauccuggagcaaaaauauucuccgcacccaggaaucugagugcguguguaucaacggcacaugcacgguggucaugaccgauggguccgccagcgagagagcggacacaaagauucuguuuaucgaagagggaaaaauuguucacaucuccccucuuucuggcagcgcccaacauguggaagagugcuccuguuauccccgguacccuggggugcgcugcgucuguagagauaauuggaagggaagcaaccggcccaucguggacauuaacguuaaggauuacucuaucguguccagcuaugucugcucuggccuggugggcgacaccccgcgcaaaaaugacagcuccucuagcuccuacuguagaaacccuaauaacgaaaaggggagccacggaguuaaaggcugggcuuucgaugacgggaaugauguguggaugggacggacaauuucugaggagcuccgcuccggcuaugaaaccuuuaaggucaucgggggauggagcaaacccaacucuaagcugcagauuaauagacaggugaucgucgaccggggcaacagauccggcuacagcgggaucuucuccguggagggaaaaucuugcauuaaucgcuguuuuuauguugaacugauccggggcagaaagcaggagacggaagugugguggacaagcaacuccauugucguguucugcgggaccucuggaaccuacggcacagggagcuggccugauggcgccgacaucaaucucaugcccauuuga

SEQ ID NO: 198255 - RNA, 1410 nt, Artificial Sequence; identical to SEQ ID NO: 198181
  derived and/or modified sequence opt5 from neuraminidase__InfluenzaA__ABG80098

SEQ ID NO: 198256 - RNA, 1410 nt, Artificial Sequence; identical to SEQ ID NO: 198125
  derived and/or modified sequence opt5 from neuraminidase__InfluenzaA__ABG80109

SEQ ID NO: 198257 - RNA, 1410 nt, Artificial Sequence
  derived and/or modified sequence opt5 from neuraminidase__InfluenzaA__ABG80120
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcaucuguauuaacggcacaugcacggucgugaugaccgauggguccgccagcgagagagcggacacaaagauccuguuuaucgaagagggaaaaauugugcacaucuccccucuuucuggcagcgcccaacaugucgaagagugcuccuguuauccccgguacccugggguucgcugcguguguagagauaauuggaagggaagcaaccggcccauuguggacaucaacgucaaggauuacucuauuguguccagcuauguuugcucuggccuggugggcgacaccccgcgcaaaaaugacagcuccucuagcuccuacuguagaaacccuaauaacgaaaaggggagccacggagucaaaggcugggcuuucgaugacgggaaugauguguggaugggacggacaaucucugaggagcuccgcuccggcuaugaaaccuuuaagguuaucgggggauggagcaaacccaacucuaagcugcagauuaauagacaggugaucgucgaccggggcaacagauccggcuacagcgggauuuucuccguggagggaaaaucuugcaucaaucgcuguuuuuaugucgaacugauucggggcagaaagcaggagacggaagugugguggacaagcaacuccaucguuguguucugcgggaccucuggaaccuacggcacagggagcuggccugauggcgccgacauuaaucucaugcccaucuga

SEQ ID NO: 198258 - RNA, 1410 nt, Artificial Sequence
  derived and/or modified sequence opt5 from neuraminidase__InfluenzaA__ABG80131
augaaccccaaucagaagaucauuaccaucggcagcgugucccugacaauugccacgaucugcuuccucaugcaaauugcuaucauggucaccacaguuacccugcacuuuaaacaguacgaguguaacucuccuccgagcaaucaggugaugcuuugcgaacccacaaucauugagagaaacaucaccgaaauuguguaucugacaaauaccacgaucgagaaggaaauuuguccuaaacucgccgaguaccggaacugguccaagccccagugcaaaaucaccggguucgcgccuuuuucuaaggacaauagcauucgccuguccgcuggaggcgauaucugggucacaagagagcccuaugugucuugugacccugggaagugcuaccaauucgcccuuggacagggcaccacacugaacaaucggcauagcaacgauaccguucacgaccgcacgccguauagaacacuccugaugaaugaacugggggugcccuuucaucucggaaccaaacaggucuguaucgccugguccucuagcuccugccacgauggcaaggcuuggcugcauguguguguuacaggccacgacgagaacgccaccgcuagcuucauuuacgaugggcggcuuguggacucuaucggauccuggagcaaaaauauucugcgcacccaggaaucugagugcgucuguaucaacggcacaugcacgguggugaugaccgauggguccgccagcgagagagcggacacaaagauucucuuuaucgaagagggaaaaaucguccacauuuccccucugucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuugucggcgacaccccgcgcaaaaaugacagcuccucuagcuccuacuguagaaacccuaauaacgaaaaggggagccacggagugaaaggcugggcuuucgaugacgggaaugauguuuggaugggacggacaauuucugaggagcugcgcuccggcuaugaaaccuuuaaggugaucgggggauggagcaaacccaacucuaagcuccagaucaauagacaggucauuguggaccggggcaacagauccggcuacagcgggaucuucuccgucgagggaaaaucuugcauuaaucgcuguuuuuauguggaacugauccggggcagaaagcaggagacggaaguuugguggacaagcaacuccauuguggucuucugcgggaccucuggaaccuacggcacagggagcuggccugauggcgccgacaucaaucugaugcccauuuga

SEQ ID NO: 198259 - RNA, 1410 nt, Artificial Sequence; identical to SEQ ID NO: 198125
  derived and/or modified sequence opt5 from neuraminidase__InfluenzaA__ABG80142

SEQ ID NO: 198260 - RNA, 1410 nt, Artificial Sequence; identical to SEQ ID NO: 198181
  derived and/or modified sequence opt5 from neuraminidase__InfluenzaA__ABG80153

SEQ ID NO: 198261 - RNA, 1410 nt, Artificial Sequence; identical to SEQ ID NO: 198125
  derived and/or modified sequence opt5 from neuraminidase__InfluenzaA__ABG80164

SEQ ID NO: 198262 - RNA, 1413 nt, Artificial Sequence; identical to SEQ ID NO: 197852
  derived and/or modified sequence opt5 from neuraminidase__InfluenzaA__ABG80186

SEQ ID NO: 198263 - RNA, 1410 nt, Artificial Sequence; identical to SEQ ID NO: 197085
  derived and/or modified sequence opt5 from neuraminidase__InfluenzaA__ABG80197

SEQ ID NO: 198264 - RNA, 1410 nt, Artificial Sequence; identical to SEQ ID NO: 197277
  derived and/or modified sequence opt5 from neuraminidase__InfluenzaA__ABG80219

SEQ ID NO: 198265 - RNA, 1410 nt, Artificial Sequence
  derived and/or modified sequence opt5 from neuraminidase__InfluenzaA__ABG80230
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaacauucuccgcacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgagucugcccaacacguugaagagugcagcuguuauccuagauaccccggggugcggugcgugugucgcgacaauuggaaaggauccaacagaccuaucgucgauauuaaugugaaggacuacagcaucguuucuuccuaugugugcagcggccuggucggcgacacaccccggaagaacgauucuuucagcuccucucauugucucgacccgaauaacgaagaagggggacacggcgugaaagggugggcuuuugaugacggaaaugauguuuggaugggccgcaccauuagcgagaagcugagauccggguacgagacguucaaagugaucgagggauggagcaagccuaacucuaaacugcagacaaaucggcaggucaucguggaacgcggcaacagauccggcuauagcgggaucuuuucugucgagggaaaguccugcauuaaucgguguuucuacguggaacucauuagaggccgcaaagaggagaccgaaguuugguggaccagcaacuccaucguggucuuuugcgggacaucuggaaccuauggcacagggagcuggcccgacggcgccgauauuaaucugaugccuaucuga

SEQ ID NO: 198266 - RNA, 1410 nt, Artificial Sequence; identical to SEQ ID NO: 197615
  derived and/or modified sequence opt5 from neuraminidase__InfluenzaA__ABG80241

SEQ ID NO: 198267 - RNA, 1410 nt, Artificial Sequence; identical to SEQ ID NO: 197615
  derived and/or modified sequence opt5 from neuraminidase__InfluenzaA__ABG80252

SEQ ID NO: 198268 - RNA, 1410 nt, Artificial Sequence; identical to SEQ ID NO: 198199
  derived and/or modified sequence opt5 from neuraminidase__InfluenzaA__ABG80263

SEQ ID NO: 198269 - RNA, 1410 nt, Artificial Sequence; identical to SEQ ID NO: 197760
  derived and/or modified sequence opt5 from neuraminidase__InfluenzaA__ABG80274

SEQ ID NO: 198270 - RNA, 1410 nt, Artificial Sequence; identical to SEQ ID NO: 197351
  derived and/or modified sequence opt5 from neuraminidase__InfluenzaA__ABG80285

SEQ ID NO: 198271 - RNA, 1410 nt, Artificial Sequence; identical to SEQ ID NO: 197351
  derived and/or modified sequence opt5 from neuraminidase__InfluenzaA__ABG80296

SEQ ID NO: 198272 - RNA, 1410 nt, Artificial Sequence; identical to SEQ ID NO: 197351
  derived and/or modified sequence opt5 from neuraminidase__InfluenzaA__ABG80307

SEQ ID NO: 198273 - RNA, 1410 nt, Artificial Sequence; identical to SEQ ID NO: 197738
  derived and/or modified sequence opt5 from neuraminidase__InfluenzaA__ABG80318

SEQ ID NO: 198274 - RNA, 1410 nt, Artificial Sequence; identical to SEQ ID NO: 197351
  derived and/or modified sequence opt5 from neuraminidase__InfluenzaA__ABG80329

SEQ ID NO: 198275 - RNA, 1410 nt, Artificial Sequence; identical to SEQ ID NO: 197351
  derived and/or modified sequence opt5 from neuraminidase__InfluenzaA__ABG80340

SEQ ID NO: 198276 - RNA, 1410 nt, Artificial Sequence; identical to SEQ ID NO: 198209
  derived and/or modified sequence opt5 from neuraminidase__InfluenzaA__ABG80351

SEQ ID NO: 198277 - RNA, 1410 nt, Artificial Sequence
  derived and/or modified sequence opt5 from neuraminidase__InfluenzaA__ABG80373
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggaucacagcaucguuucuuccuacgugugcagcggccuggucggcgacaccccgcgcaaaaacgacucuagcuccucuagcuauuguagaaauccuaacaaugaaaaggggucccauggagugaaaggcugggcuuucgaugacgggaacgauguuuggaugggacggacaauuagcgaggagcuccgcucuggcuacgaaaccuuuaaggugaucgggggaugguccaaacccaauagcaagcugcagaucaacagacaggucauuguggaccggggcaauagaucuggcuauuccgggaucuucagcgucgagggaaaauccugcauuaaccgcuguuuuuacguggaacugauccggggcagaaagcaggagacggaaguuugguggacaucuaauagcauuguggucuucugcgggaccuccggaaccuauggcacagggucuuggccugauggcgccgacaucaaccucaugcccauuuga

SEQ ID NO: 198278 - RNA, 1410 nt, Artificial Sequence; identical to SEQ ID NO: 198277
  derived and/or modified sequence opt5 from neuraminidase__InfluenzaA__ABG80384

SEQ ID NO: 198279 - RNA, 1410 nt, Artificial Sequence
  derived and/or modified sequence opt5 from neuraminidase__InfluenzaA__ABG80395
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccaagagagcggacacaaaaauucuguuuaucgaggaaggaaagaucguccacauuagcccucuuuccggcucugcccaacauguugaggaaugcagcuguuauccccgguacccuggggugcgcugcguguguagagauaacuggaagggauccaaccggcccaucgucgacauuaaugugaaagauuacagcaucguuucuuccuaugugugcagcggccuggucggcgacaccccgcgcaagaacgacucuagcuccucuagcuacuguagaaauccuaacaaugagaaagggucccacggagugaagggcugggcuuucgaugacgggaacgauguuuggaugggacggacaauuagcgaggaacuccgcucuggcuaugagaccuuuaaagugaucgggggaugguccaagcccaauagcaaacugcagaucaacagacaggucauuguggaccggggcaauaugucuggcuacuccgggaucuucagcgucgaaggaaaguccugcauuaacagauguuuuuauguggagcugauccgcggccggaagcaggaaacggagguuugguggacaucuaauagcauuguggucuucugcgggaccuccggaaccuacggcacagggucuuggccugauggcgccgacaucaaccucaugcccauuuga

SEQ ID NO: 198280 - RNA, 1410 nt, Artificial Sequence; identical to SEQ ID NO: 198209
  derived and/or modified sequence opt5 from neuraminidase__InfluenzaA__ABG80406

SEQ ID NO: 198281 - RNA, 1410 nt, Artificial Sequence; identical to SEQ ID NO: 198209
  derived and/or modified sequence opt5 from neuraminidase__InfluenzaA__ABG80417

SEQ ID NO: 198282 - RNA, 1410 nt, Artificial Sequence; identical to SEQ ID NO: 198209
  derived and/or modified sequence opt5 from neuraminidase__InfluenzaA__ABG80428

SEQ ID NO: 198283 - RNA, 1410 nt, Artificial Sequence; identical to SEQ ID NO: 197150
  derived and/or modified sequence opt5 from neuraminidase__InfluenzaA__ABG88292

SEQ ID NO: 198284 - RNA, 1413 nt, Artificial Sequence; identical to SEQ ID NO: 198074
  derived and/or modified sequence opt5 from neuraminidase__InfluenzaA__ABG88314

SEQ ID NO: 198285 - RNA, 1413 nt, Artificial Sequence
  derived and/or modified sequence opt5 from neuraminidase__InfluenzaA__ABG88325
augaaccccaaucagaagaucauuaccaucggcagcacauccauugccaucgggauuaucucucugauccuccaaauuggaaacaucauuagcaucugggcuucccacucuauucagacgggcagccagaaucauaccgggaucugcaaccagagaauuaucacauacgaaaauuccaccugggugaaccaaacauaugucaauaucaacaauaccucuguuguggccggaaaagacaagacaagcaugacccuggcgggcaacuccagccuuuguccuauucgggggugggcuaucuacacgaaagauaauucuauucgcaucggauccaagggcgacguguucgucauuagagagccguuuaucagcugcucucaccuggagugucggaccuucuuucucacacagggcgcccugcuuaacgauaaacauuccaaugggaccgugaaggaccgcagccccuauagagcccugaugucuugcccucucggagaagcucccuccccuuacaacagccgguucgaguccguugccuggucugcuagcgccugucacgauggccugggguggcugacaaucggaauuuccggccccgacaauggggcgguggccguccucaaguauaacggaaucauuaccgaaacgaucaaaagcuggaagaaacgcauucugagaacacaggagucugagugcguguguaugaacggcuccugcuuuaccaucaugacagauggcccuagcaauggggcugccucuuaccggaucuucaagauugaaaaaggacgcguuaccaagagcaucgagcuugacgcuccgaacuaucauuacgaagaguguuccugcuaccccgauaccggcacagugaugugugucugcagagacaauuggcacgggucuaaccggccuugggugagcuuuaaucagaaccuggauuaucaaacgggauacauuugcuccggcguguucggggacaauccccgcccuaaggauggagagggcagcuguaaccccgucaccgccgacggcgcggacgggguuaaaggauuuucuuauagauacggcaaugggguguggaucggacggacaaaguccaaccgccucagaaaaggcuucgaaaugauuugggauccgaauggguggaccgacacagauagcgacuuuucuaugaagcaggauaucguggccaugaccgacugguccggcuauagcggauccuucguccagcacccugagcugacgggccuugauugcaugcggcccuguuuuuggguggaacugguuagagggcucccucgcgagaacacaaccauuuggaccucuggaagcuccaucucuuucugcggcgugaauagcgacacagcuaacugguccuggcccgauggggccgaacugcccuucaccaucgacaaauga

SEQ ID NO: 198286 - RNA, 1413 nt, Artificial Sequence
  derived and/or modified sequence opt5 from neuraminidase__InfluenzaA__ABG88336
augaaccccaaucagaagaucauuaccaucggcagcauuugcauggccaucgggauuaucucccugauccuccaaauuggaaacaucauuucuaucugggugagccacuccauucagacaggcaaucagaaccauacggggaucuguaaucagagaauuaucaccuacgagaacucuacaugggucaaucaaaccuauguuaacaucaauaacacaaaugugguggcuggaaaagacaccacaagcgucacccuggccggcaacuccucucuuugcccugugcgggggugggcgauuuacagcaaggauaauuccauccgcauuggaagcaaaggcgacguuuucgugaucagagaaccguuuauuucuuguucccaccuggagugccggacguucuuucucacccagggcgcucugcuuaacgauaagcauagcaaugggacagucaaagaccgcucucccuauagagcccugauguccuguccuaucggagaagcccccagcccuuacaacucucgguucgaguccguggcuuggagcgccuccgcuugccacgauggcaugggguggcucaccaucggaauuucuggccccgacgauggggccguugcggugcugaaguauaacggaaucauuacagaaaccaucaagagcuggcgcaaacggauucugagaacgcaggaguccgagugugucugcgugaauggcagcuguuuuacaaucaugaccgacggcccuucuaacgggccggccuccuacaagaucuucaaaauugaaaagggaaaaaucacaaagagcauugagcucgaugcucccaauucucauuaugaagagugcagcuguuacccugacaccggcaccgugaugugcgucugccgcgauaacuggcacggguccaauagacccuggguuucuuuuaaccagaaucuggacuaccaacuuggauauaucuguagcggcauuuucggggauaacccucggcccaaggacggaaaaggcuccugcggcccggugacaguggacggggccgauggagucaagggcuuuagcuaccgcuaugggaauggaguguggaucggcagaacgaaaucuaacuccagccggaagggguucgagaugauuugggacccuaauggcuggaccgauacagacucuaacuuucugguuaaacaggauguggucgcuaugaccgacugguccggauacagcggcuccuucgugcagcaccccgaacucacagggcuggauuguaugcgcccuugcuuuuggguugagcuuaucagaggacggcccagagaaaccacgacaaucuggaccucuggcagcuccauuucuuucuguggggugaauagcgacaccgucaacugguccuggcccgauggagccgagcugccuuucacaaucgacaaguga

SEQ ID NO: 198287 - RNA, 1413 nt, Artificial Sequence
  derived and/or modified sequence opt5 from neuraminidase__InfluenzaA__ABG88347
augaaccccaaucagaagaucauuaccaucggcagcauuugcauggccaucgggauuaucggacugauccuccaaauuggcaacaucauuuccaucugggugucucacagcauucagacagggucccagaaucauacgggaaucuguaaccagagaauuaucaccuacgaaaauucuacaugggucaaccaaaccuauguuaauaucaacaauacaaacgugguggcuggcaaagacaccacaagcgucacccuggccggaaauuccucucuuugcccugugcgggggugggcgauuuacagcaaggauaacuccauccgcauuggcagcaaaggcgacguuuucgugaucagagagccguuuauuucuuguucccaccuggagugccggacguucuuucucacccagggggcucugcuuaaugauaagcauagcaacggaacagucaaagaccgcucucccuauagagcccugauguccuguccuaucggcgaagcccccagcccuuacaauucucgguucgaguccguggcuuggagcgccuccgcuugccacgaugggaugggauggcucaccaucggcauuucugggcccgacgauggagccguugcggugcugaaguauaacggcaucauuacagaaaccaucaagagcuggcgcaaacggauucugagaacgcaggaguccgagugugucugcgugaacggcagcuguuuuacaaucaugaccgacgggccuucuaauggaccggccuccuacaagaucuucaaaauugaaaagggcaaaaucacaaagagcauugagcucgaugcucccaacucucauuaugaagagugcagcuguuacccugacaccgggaccgugaugugcgucugccgcgauaauuggcacggauccaacagacccuggguuucuuuuaaucagaaccuggacuaccaacuuggcuauaucuguagcgggauuuucggagauaauccucggcccaaggacggcaaaggcuccugcgggccggugacaguggacggagccgauggcgucaagggguuuagcuaccgcuauggaaacggcguguggaucgggagaacgaaaucuaauuccagccggaagggcuucgagaugauuugggacccuaacggauggaccgauacagacucuaauuuucugguuaaacaggauguggucgcuaugaccgacugguccggcuacagcggguccuucgugcagcaccccgaacucacaggacuggauuguaugcgcccuugcuuuuggguugagcuuaucagaggccggcccagagaaaccacgacaaucuggaccucugggagcuccauuucuuucuguggagugaacagcgacaccgucaauugguccuggcccgauggcgccgagcugccuuucacaaucgacaaguga

SEQ ID NO: 198288 - RNA, 1410 nt, Artificial Sequence
  derived and/or modified sequence opt5 from neuraminidase__InfluenzaA__ABG88358
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacaaaaaugccaccgcuuccuucauuuacgaugggcggcugguggacagcaucggaucuugguccaagaacauucuccgcacccaggagagcgaaugcgucuguaucaauggcacaugcacgguggugaugaccgaugggucugccuccgacagagcggauacaaaaauucuguuuaucgaggagggaaagaucguccacauucggccucuuagcggcuccgcccaacauguugaagagugcucuuguuauccccgcuacccuggggugagaugcgugugucgggacaacuggaagggaagcaaccgccccaucgucgauauuaaugugaaagacuacuccaucguuagcucuuaugugugcuccggccuggucggcgacaccccgagaaagaacgauagcucuagcuccucuuacuguuggaauccuaacaaugaaaaagggggacacggcgugaaggggugggcuuucgacgauggaaacgacguuuggaugggccggacaauuagcgaggaaucccgcagcggguaugagaccuuuaaagugaucggaggcuggucuaagcccaauuccaaacuccagaucaacagacaggucauuguggaucggggcaauagaagcggguacucuggaaucuucuccgucgagggcaagagcugcauuaaccgcuguuuuuauguggaacugauccgggggagaaagcaggagacggaaguuugguggacauccaauucuauuguggucuucugcggaaccagcggcaccuacgggacaggcuccuggccugacggagccgauaucaaccugaugcccauuuga

SEQ ID NO: 198289 - RNA, 1410 nt, Artificial Sequence; identical to SEQ ID NO: 198137
  derived and/or modified sequence opt5 from neuraminidase__InfluenzaA__ABG88369

SEQ ID NO: 198290 - RNA, 1410 nt, Artificial Sequence; identical to SEQ ID NO: 198137
  derived and/or modified sequence opt5 from neuraminidase__InfluenzaA__ABG88380

SEQ ID NO: 198291 - RNA, 1410 nt, Artificial Sequence; identical to SEQ ID NO: 198137
  derived and/or modified sequence opt5 from neuraminidase__InfluenzaA__ABG88391

SEQ ID NO: 198292 - RNA, 1410 nt, Artificial Sequence; identical to SEQ ID NO: 198124
  derived and/or modified sequence opt5 from neuraminidase__InfluenzaA__ABG88402

SEQ ID NO: 198293 - RNA, 1410 nt, Artificial Sequence; identical to SEQ ID NO: 198181
  derived and/or modified sequence opt5 from neuraminidase__InfluenzaA__ABG88413

SEQ ID NO: 198294 - RNA, 1410 nt, Artificial Sequence; identical to SEQ ID NO: 198125
  derived and/or modified sequence opt5 from neuraminidase__InfluenzaA__ABG88424

SEQ ID NO: 198295 - RNA, 1410 nt, Artificial Sequence; identical to SEQ ID NO: 198125
  derived and/or modified sequence opt5 from neuraminidase__InfluenzaA__ABG88435

SEQ ID NO: 198296 - RNA, 1410 nt, Artificial Sequence; identical to SEQ ID NO: 198125
  derived and/or modified sequence opt5 from neuraminidase__InfluenzaA__ABG88446

SEQ ID NO: 198297 - RNA, 1410 nt, Artificial Sequence
  derived and/or modified sequence opt5 from neuraminidase__InfluenzaA__ABG88457
augaaccccaaucagaagaucauuaccaucggcagcgugucccugacaacggccaccauuugcuuccucaugcaaaucgcuauucuggucacaaccguuacacuucacuuuaaacaguacgaguguaacucuccuccgaauaaccaggugaugcugugcgaacccaccaucaucgagagaaauauuacagaaaucguguaucucaccaacacgaccauugagaaggaaaucuguccuaaacuggccgaguaccggaauuggagcaagccccagugcaaaauuacaggguucgcgccuuuuuccaaggacaacucuauccgccuuagcgcuggaggcgauauuugggucaccagagagcccuauguguccugugacccugggaagugcuaccaauucgcccugggacagggcacaacccucaauaaccggcauucuaaugauacgguucacgaccgcacaccguauagaacccugcugaugaacgaacucggggugcccuuucaucugggaacaaaacaggucuguaucgccuggagcuccagcucuugccacgauggcaaggcuuggcuucauguguguguuaccggccacgacgagaaugccaccgcuuccuucaucuacgaugggcggcugguggacagcauuggaucuugguccaaaaacauccuccgcacacaggaaagcgagugcgucuguauuaauggcacgugcaccguggugaugacagaugggucugccuccgagagagcggacaccaagauccuguuuauuaaagaaggaaagaucguccacaucagcccucuuuccggcucugcccaacauguugaggaaugcagcuguuauccccgguacccuggggugcgcugcguguguagagauaacuggaagggauccaaccggcccauugucgacaucaaugugaaagauuacagcauuguuucuuccuaugugugcagcggccuggucggcgacacaccgcgcaagaacgacucuagcuccucuagcuacugucagaauccuaacaaugagaaagggucccacggagugaagggcugggcuuucgaugacgggaacgauguuuggaugggaagaaccaucagcgaggaacuccggucuggcuaugagacguuuaaagugauugggggaugguccaagcccaauagcaaacugcagaucaaccgccaggucaucguggacagaggcaaucggucuggcuacuccgggauuuucagcgucgaaggaaaguccugcaucaacagauguuuuuauguggagcugauucgcggccggaagcaagaaacagagguuugguggaccucuaauagcaucguggucuucugcgggaccuccggaacauacggcaccgggucuuggccugauggcgccgacauuaaccucaugcccaucuga

SEQ ID NO: 198298 - RNA, 1410 nt, Artificial Sequence; identical to SEQ ID NO: 198125
  derived and/or modified sequence opt5 from neuraminidase__InfluenzaA__ABG88468

SEQ ID NO: 198299 - RNA, 1410 nt, Artificial Sequence; identical to SEQ ID NO: 198125
  derived and/or modified sequence opt5 from neuraminidase__InfluenzaA__ABG88479

SEQ ID NO: 198300 - RNA, 1410 nt, Artificial Sequence; identical to SEQ ID NO: 198125
  derived and/or modified sequence opt5 from neuraminidase__InfluenzaA__ABG88490

SEQ ID NO: 198301 - RNA, 1410 nt, Artificial Sequence; identical to SEQ ID NO: 198125
  derived and/or modified sequence opt5 from neuraminidase__InfluenzaA__ABG88501

SEQ ID NO: 198302 - RNA, 1410 nt, Artificial Sequence; identical to SEQ ID NO: 198125
  derived and/or modified sequence opt5 from neuraminidase__InfluenzaA__ABG88512

SEQ ID NO: 198303 - RNA, 1410 nt, Artificial Sequence; identical to SEQ ID NO: 198125
  derived and/or modified sequence opt5 from neuraminidase__InfluenzaA__ABG88523

SEQ ID NO: 198304 - RNA, 1410 nt, Artificial Sequence
  derived and/or modified sequence opt5 from neuraminidase__InfluenzaA__ABG88534
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgagcaaucaggugaugcugugcgaacccacaaucauugagagaaacaucaccgaaauuguguaucucacaaauaccacgaucgagaaggaaauuuguccuaaacuggccgaguaccggaacugguccaagccccagugcaaaaucaccggguucgcgccuuuuucuaaggacaauagcauucgccuuuccgcuggaggcgauaucugggucacaagagagcccuaugugucuugugacccugggaagugcuaccaauucgcccugggacagggcaccacacucaacaaucggcauagcaacgauaccguucacgaccgcacgccguauagaacacugcugaugaaugaacucggggugcccuuucaucugggaaccaaacaggucuguaucgccugguccucuagcuccugccacgauggcaaggcuuggcuucauguguguguuacaggccacgacgagaacgccaccgcuagcuucauuuacgaugggcggcugguggacucuaucggauccuggagcaaaaauauucuccgcacccaggaaucugagugcgucuguaucaacggcacaugcacgguggugaugaccgauggguccgccagcgagagagcggacacaaagauucuguuuaucgaagagggaaaaaucguccacauuuccccucuuucuggcagcgcccaacauguugaagagugcuccuguuauccccgguacccuggggugcgcugcguguguagagauaauuggaagggaagcaaccggcccaucgucgacauuaacgugaaggauuacucuaucguuuccagcuaugugugcucuggccuggucggcgacaccccgcgcaaaaaugacagcuccucuagcuccuacuguagaaacccuaauaacgaaaaggggagccacggagugaaaggcugggcuuucgaugacgggaaugauguuuggaugggacggacaauuucugaggagcuccgcuccggcuaugaaaccuuuaaggugaucgggggauggagcaaacccaacucuaagcugcagaucaauagacaggucauuguggaccggggcaacagauccggcuacagcgggaucuucuccgucgagaauaaaucuugcauuaaccgcuguuuuuauguggaacugauccggggaagaaagcaggagacggaaguuugguggacaagcaauuccauuguggucuucugcggcaccucugggaccuacggaacaggcagcuggccugauggggccgacaucaaccucaugcccauuuga

SEQ ID NO: 198305 - RNA, 1410 nt, Artificial Sequence; identical to SEQ ID NO: 197817
  derived and/or modified sequence opt5 from neuraminidase__InfluenzaA__ABG88567

SEQ ID NO: 198306 - RNA, 1410 nt, Artificial Sequence
  derived and/or modified sequence opt5 from neuraminidase__InfluenzaA__ABG88600
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacccgccgaguaccggaauuggagcaagccucagugcaacaucaccggguucgcgcccuuuuccaaagacaauucuauucgccugagcgcuggaggcgauaucugggucacaagagagccuuauguguccugugacccggauaagugcuaccaauucgcccuugggcagggaaccacacugaacaauggccauucuaacgacaccguucacgaucggacgcccuaucgcacacuccugaugaaugaacugggggugccuuuucaucucggaaccaagcaggucuguaucgccuggagcuccagcucuugccacgacggcaaagccuggcugcauguguguguuacaggcgaugacgagaacgcuaccgcuuccuucauuuacaaugggagacuuguggauagcaucggaucuugguccaagaaaauucugcggacccaggaaagcgagugcgucuguaucaacggcacaugcacgguggugaugaccgacgggucugccuccggaaaggcggauacaaaaauucucuuuaucgaggaaggcaagaucguccacaccagccugcuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaagcugcgcagcggauacgagacguuuaaagugauugaaggcuggucuaagcccaauuccaaacugcagaucaacagacaggucaucguggaccggggcaaucgcagcggguauucuggaauuuucuccgucgagggcaagagcugcaucaacagauguuuuuacguggaacucauucgggggagaaagcaggagacagaaguucuguggaccuccaauucuaucguggucuucugcggaaccagcggcacauaugggaccggcuccuggccugauggagccgacauuaaccuuaugcccaucuga

SEQ ID NO: 198307 - RNA, 1410 nt, Artificial Sequence; identical to SEQ ID NO: 197178
  derived and/or modified sequence opt5 from neuraminidase__InfluenzaA__ABG88611

SEQ ID NO: 198308 - RNA, 1410 nt, Artificial Sequence; identical to SEQ ID NO: 197190
  derived and/or modified sequence opt5 from neuraminidase__InfluenzaA__ABG88622

SEQ ID NO: 198309 - RNA, 1410 nt, Artificial Sequence; identical to SEQ ID NO: 197178
  derived and/or modified sequence opt5 from neuraminidase__InfluenzaA__ABG88633

SEQ ID NO: 198310 - RNA, 1410 nt, Artificial Sequence; identical to SEQ ID NO: 198229
  derived and/or modified sequence opt5 from neuraminidase__InfluenzaA__ABG88655

SEQ ID NO: 198311 - RNA, 1410 nt, Artificial Sequence; identical to SEQ ID NO: 198229
  derived and/or modified sequence opt5 from neuraminidase__InfluenzaA__ABG88666

SEQ ID NO: 198312 - RNA, 1410 nt, Artificial Sequence; identical to SEQ ID NO: 197615
  derived and/or modified sequence opt5 from neuraminidase__InfluenzaA__ABG88677

SEQ ID NO: 198313 - RNA, 1410 nt, Artificial Sequence; identical to SEQ ID NO: 198229
  derived and/or modified sequence opt5 from neuraminidase__InfluenzaA__ABG88688

SEQ ID NO: 198314 - RNA, 1410 nt, Artificial Sequence; identical to SEQ ID NO: 197615
  derived and/or modified sequence opt5 from neuraminidase__InfluenzaA__ABG88699

SEQ ID NO: 198315 - RNA, 1410 nt, Artificial Sequence; identical to SEQ ID NO: 197351
  derived and/or modified sequence opt5 from neuraminidase__InfluenzaA__ABG88710

SEQ ID NO: 198316 - RNA, 1410 nt, Artificial Sequence; identical to SEQ ID NO: 197351
  derived and/or modified sequence opt5 from neuraminidase__InfluenzaA__ABG88721

SEQ ID NO: 198317 - RNA, 1410 nt, Artificial Sequence
  derived and/or modified sequence opt5 from neuraminidase__InfluenzaA__ABG88732
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaaggauuacagcaucguuucuuccuaugugugcagcggccuggucggcgacaccccgcgcaaaaacgacucuagcuccucuagcuacuguagaaauccuaacaaugaaaaggggucccacggagugaaaggcugggcuuucgaugacgggaacgauguuuggaugggacggacaauuagcgaggagcuccgcucuggcuaugaaaccuuuaaggugaucgggggaugguccaaacccaauagcaagcugcagaucaacagacaggucauuguggagcggggcaauagaucuggcuacuccgggaucuucagcgucgaaggaaaauccugcauuaaccgcuguuuuuauguggagcugauccggggcagaaagcaggaaacggagguuugguggacaucuaauagcauuguggucuucugcgggaccuccggaaccuacggcacagggucuuggccugacggcgccgauaucaaccucaugcccauuuga

SEQ ID NO: 198318 - RNA, 1410 nt, Artificial Sequence; identical to SEQ ID NO: 198277
  derived and/or modified sequence opt5 from neuraminidase__InfluenzaA__ABG88743

SEQ ID NO: 198319 - RNA, 1410 nt, Artificial Sequence; identical to SEQ ID NO: 198277
  derived and/or modified sequence opt5 from neuraminidase__InfluenzaA__ABG88754

SEQ ID NO: 198320 - RNA, 1410 nt, Artificial Sequence; identical to SEQ ID NO: 197543
  derived and/or modified sequence opt5 from neuraminidase__InfluenzaA__ABG88765

SEQ ID NO: 198321 - RNA, 1410 nt, Artificial Sequence; identical to SEQ ID NO: 198209
  derived and/or modified sequence opt5 from neuraminidase__InfluenzaA__ABG88776

SEQ ID NO: 198322 - RNA, 1410 nt, Artificial Sequence; identical to SEQ ID NO: 198209
  derived and/or modified sequence opt5 from neuraminidase__InfluenzaA__ABG88787

SEQ ID NO: 198323 - RNA, 1410 nt, Artificial Sequence
  derived and/or modified sequence opt5 from neuraminidase__InfluenzaA__ABG88820
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaaaugcccuaagcucgcugaguaccggaauugguccaaaccccaguguaacaucaccggguucgccccuuuuucuaaggacaauagcauucgccuguccgcgggaggcgauaucugggugacaagagagcccuaugucucuugcgacccugauaaguguuaccaauucgcucuugggcagggaaccacacugaacaaugugcauagcaacgacaccguucgggaucgcacgccguauagaacacuccugaugaaugaacugggcgugcccuuucaccucgggaccaaacaggucugcaucgccugguccagcagcuccugucaugacggaaaggccuggcugcacgugugcguuacaggcgaugacaaaaacgcuaccgccagcuucauuuacaauggccggcuuguggauucuaucgucuccuggagcaaggagauucugcgcacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccuagauaccccggcgugcggugugucugccgcgacaacuggaaagggagcaauagaccuauuguggauaucaacauuaaggacuacucuaucguuuccagcuauguguguucuggacuugucggcgacacgccccggaaaaaugauagcuccucuagcucccacugccuggacccgaacaaugaggaaggcgggcauggagugaagggcugggccuucgaugacgggaacgauguuuggaugggacgcaccauuagcgagaaacucagacugggcuacgagacauuuaaggugaucgaaggguggucuaauccuaacuccaaacugcagaccaaucggcaggucaucguggaccgcggaaacagaagcggcuauucuggcauuuucuccgucgaggggaagucuuguaucaaucggugcuuuuacguggaacucauuagaggacgcaaggaggaaaccgagguucuguggacauccaacucuaucguggucuucuguggcaccagcgggacauauggaacgggcuccuggcccgauggggcugacauuaaucuuaugccuaucuga

SEQ ID NO: 198324 - RNA, 1350 nt, Artificial Sequence
  derived and/or modified sequence opt5 from neuraminidase__InfluenzaA__ABI16506
augaaccccaaucagaagaucauuaccaucggcagcauuugcauggugaucgggauugucucccugaugcuccaaaucggaaacaugguuucucugugggugagccacuccauccagacaggcaaucagcaucagguggagccuauuucuaacacgaauuuccuuaccgaaaaagccgucgcuagcgugacacuggccgggaacuccucucucuguccgaucagaggaugggcgguucacagcaaggacaauuccauucggaucggcagcaaaggggauguguuugucauucgcgagcccuucaucucuugcucccaucuggaauguagaaccuuuuuccuuacacaaggagcucugcucaacgacaagcacagcaauggcaccgugaaagaucggucuccucaucgcacacugauguccugccccguuggcgaggccccuagccccuacaacucuagauuugaauccguggccuggagcgcuuccgccugucacgacgggaccucuuggcugacgauuggaaucagcggcccugauaauggggcugucgccgugcucaaguauaacggaaugaucaccgacacaauuaaguccuggcggaauaacauccugcgcacccaggagagcgagugcgugugugucaauggcucuugcuucacaguuaugaccgaugggccguccaacggacaggcgagcuacaaaauuuuuaagauggaaaaaggcaagguggugaaaucugucgagcuugacgcccccaacuaucacuacgaagaguguagcugcuauccugaugcuggcgagaucacgugugugugcagagacaauuggcauggguccaaccggcccuggguuucuuucaaucagaaccuggaauaccaaauuggauauaucugcagcggcguguuuggggauaauccucgccccaacgacggaacaggcuccugugggccggucagcccuaauggagccuacggcgugaagggcuucucuuuuaaguacgggaacggaguuuggaucggcagaaccaaaucccccagcucucgguccggguucgagaugauuugggauccuaauggauggacagaaaccgacagcuccuuuucugugaagcaggacaucgucgcuauuaccgauuggagcggcuauuccgggucuuucgugcagcaccccgagcucacaggccuggacugcauccgccccuguuucugggucgaacuuauuagaggacggccuaaagagagcacgaucuggaccuccggcagcucuaucuccuuuugcggggugaacagcgauacaguuucuugguccuggccggacggagccgagcugcccuucaccauugauaaguga

SEQ ID NO: 198325 - RNA, 1413 nt, Artificial Sequence; identical to SEQ ID NO: 197989
  derived and/or modified sequence opt5 from neuraminidase__InfluenzaA__ABI20840

SEQ ID NO: 198326 - RNA, 1413 nt, Artificial Sequence
  derived and/or modified sequence opt5 from neuraminidase__InfluenzaA__ABI20862
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagcuaccgcauuuucaagaucgaaaaaggaaagauuaccaaaucuaucgagcucgaugcccccaacagccauuaugaagagugcuccuguuacccugacaccggcacagugaugugcgugugcagagauaauuggcacgggucuaaccggcccugggucagcuuuaaucagaaccuggacuaccaaacgggauauauuuguuccggcguuuucggggauaauccucgccccaaggacggaaagggcagcugcgacccggugaccguggauggcgcugacggggucaaaggauuuucuuacagauauggcaacgggguguggaucggacggacaaaguccaauagcucucgcaaaggcuucgagaugauuugggauccuaacggguggaccgacacagauuccaauuuucuuguuaagcaggacguggucgccaugaccgauuggagcggcuacuccggaucuuucgugcagcaccccgaacugacgggccucgacuguaugagaccuugcuuuuggguugagcugauccgggggagaccccgcgagaaaacaaccaucuggaccagcggauccucuauuagcuucuguggcgugaacuccgauacagcuaauuggagcuggcccgacggggccgaacuuccuuucaccaucgauaaguga

SEQ ID NO: 198327 - RNA, 1413 nt, Artificial Sequence
  derived and/or modified sequence opt5 from neuraminidase__InfluenzaA__ABI20873
augaaccccaaucagaagaucauuaccaucggcagcauuuccauggccaucgggauuaucucucugacacuccaaaucggaaacauuaucagcauuugggcuucccacucuauccagacgggcagccagaaucauaccgggauuugcaaccagagaaucauuacauacgaaaauuccaccugggugaaccaaacauaugucaauaucaacaauaccaacguuguggccgagaaagacaagacaucugugacccuggcgggaaauagcucccuuuguccuauccggggcugggcuauuuacacgaaagauaacagcauccgcauugggucuaagggagacgucuucgugaucagagagccguuuauuuccugcagccaccuggaaugucggaccuucuuucucacacagggcgcccugcuuaaugauaaacauucuaacggcaccguuaaggaccgcucccccuauagagcccugaugagcugcccucucggggaggcucccucuccuuacaauucccgguucgaaagcguggccugguccgcuacagccugucacgauggaaucggcuggcugaccaucgggauuucuggacccgacaacggcgcggucgccgugcugaaguauaacgggguuaucacggagacaauuaaaagcuggaagaaacagauccuccgcacccaggaguccgaaugcgugugugucaauggaagcugcuuuacaauuaugaccgauggcccuucuaacggcgcugccuccuacagaaucuucaagaucgagaaagggaagauuaccaagagcaucgaacuggacgcuccgaauuuucauuaugaggaguguucuugcuaccccgauacaggaacggugaugugugugugccgggacaacuggcacggcagcaaucgcccuugggucuccuucaaccaaaaucuugauuaccagauuggguauaucugcucuggaguuuuuggcgacaaccccagaccuaaagauggggaaggaagcuguaaucccgugaccguggacggcgccgacggcgucaagggguucuccuaccgguauggaaacggcguguggauugggcgcacaaaaagcaauagacugcggaagggauuugagaucauuugggauccgaacggcuggaccgacacagauucugacuucuccguuaaacaggauguggucgcgaugaccgacuggagcggguacucuggcuccuuugugcagcacccugaacucacgggacuggauugcaugcgccccuguuucuggguugagcuugugagaggccugccucgggaaaaugccacaaucuggaccagcggguccucuaucagcuucugcggagucaacuccgacaccgcuaauuggucuuggcccgauggcgccgagcuccccuuuacaauugacaaguga

SEQ ID NO: 198328 - RNA, 1410 nt, Artificial Sequence; identical to SEQ ID NO: 198124
  derived and/or modified sequence opt5 from neuraminidase__InfluenzaA__ABI20895

SEQ ID NO: 198329 - RNA, 1410 nt, Artificial Sequence; identical to SEQ ID NO: 198137
  derived and/or modified sequence opt5 from neuraminidase__InfluenzaA__ABI20906

SEQ ID NO: 198330 - RNA, 1410 nt, Artificial Sequence; identical to SEQ ID NO: 198125
  derived and/or modified sequence opt5 from neuraminidase__InfluenzaA__ABI20928

SEQ ID NO: 198331 - RNA, 1410 nt, Artificial Sequence; identical to SEQ ID NO: 198125
  derived and/or modified sequence opt5 from neuraminidase__InfluenzaA__ABI20939

SEQ ID NO: 198332 - RNA, 1410 nt, Artificial Sequence; identical to SEQ ID NO: 198125
  derived and/or modified sequence opt5 from neuraminidase__InfluenzaA__ABI20950

SEQ ID NO: 198333 - RNA, 1410 nt, Artificial Sequence; identical to SEQ ID NO: 198125
  derived and/or modified sequence opt5 from neuraminidase__InfluenzaA__ABI20961

SEQ ID NO: 198334 - RNA, 1410 nt, Artificial Sequence; identical to SEQ ID NO: 197851
  derived and/or modified sequence opt5 from neuraminidase__InfluenzaA__ABI20983

SEQ ID NO: 198335 - RNA, 1410 nt, Artificial Sequence
  derived and/or modified sequence opt5 from neuraminidase__InfluenzaA__ABI20994
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacaaucggacgccguaucgcacacugcugaugaacgaacucggggugcccuuucaucugggaaccaagcaggucuguaucgccuggagcuccagcucuugccacgauggcaaagccuggcuucauguguguguuacaggcgacgaugagaaugcuaccgcuuccuucauuuacaacgggagacugguggacagcaucggaucuugguccaagaaaauucuccggacccaggaaagcgagugcgucuguaucaacggcacaugcacgguggugaugaccgaugggucugccuccggaaaggcggacacaaaaauucuguuuaucgaggaaggcaagaucguccacaccagcucccuuucugggagcgcccaacacguugaggaaugcuccuguuauccucgcuaccccggagugagaugcgugugucgggauaauuggaagggcagcaaccgcccuauugucgacaucaaugugaaagauuacucuauuguuuccagcuaugugugcucuggccuggucggggacacacccagaaagaacgacagcuccucuagcucccauugucucgauccgaauaacgaggaaggaggccacggggugaaaggaugggcuuucgacgauggcaaugacguuuggauggggcggaccaucagcgagaagcugcgcucuggauacgagacguuuaaagugauugaaggcugguccaagccuaacagcaaacugcagaucaauagacaggucaucguggaucggggcaaccgcucuggguauuccggaauuuucagcgucgaguccaagucuugcaucaauagauguuuuuacguggaacucauucggggcagaaagcaggagacagaaguucuguggaccagcaacuccaucguggucuucugcgggaccucuggaacauauggcaccgggagcuggcccgacggcgccgauauuaaucuuaugccuaucuga

SEQ ID NO: 198336 - RNA, 1410 nt, Artificial Sequence
  derived and/or modified sequence opt5 from neuraminidase__InfluenzaA__ABI21005
augaaccccaaucagaagaucauuaccaucggcagcgugucccugacaauugccacgaucugcuuccucaugcaaauugcuguccugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggcuuggcuucauguuugugugacaggcgaugacgagaacgccaccgcuuccuucaucuacaaugggagacuggccgauagcauuggaucuugguccaagaaaauccuccggacccaggaaagcgagugcgucuguauuaacggcacaugcacgguggugaugaccgacgggucugcguccggaaaggccgauacaaaaauccuguuuauugaggaaggcaagaucguccacaccagccuucuguccgggucugcucaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccucgucggggacacacccagaaagaaugauucuagcuccucuagccauugucuggacccgaacaaugaggaaggaggccacggggugaaaggaugggccuucgaugacggcaacgauguuuggauggggcggaccauuuccgagaagcugcgcagcggauacgagacguuuaaagugaucgaaggcuggucuaagccuaauuccaaacuccagauuaacagacaggucaucguggaccggggcaaucgcagcggguauucuggaaucuucuccgucgagggcaagagcugcauuaacagauguuuuuacguggaacugauccgggggagaaagcaggagacagaaguucuuuggaccuccaauucuauuguggucuucugcggaaccagcggcacauaugggaccggcuccuggcccgauggagcugacaucaaccugaugccuauuuga

SEQ ID NO: 198337 - RNA, 1410 nt, Artificial Sequence; identical to SEQ ID NO: 197178
  derived and/or modified sequence opt5 from neuraminidase__InfluenzaA__ABI21016

SEQ ID NO: 198338 - RNA, 1410 nt, Artificial Sequence
  derived and/or modified sequence opt5 from neuraminidase__InfluenzaA__ABI21027
augaaccccaaucagagaaucauuaccaucggcagcgugucccugacaauugccacgaucugcuuccucaugcaaauugcuauccuggucaccacaguuacccuucacuuuaagcaguacgaguguaacucuccuccgaauaaccaggugaugcugugcgaacccacaaucauugagcggaauaucaccgaaauuguguaucucacaaacaccacgaucgagaaagaaauuuguccuaagcuggccgaguaccgcaauuggagcaaaccccagugcaacaucaccggguucgcgccuuuuuccaaggacaauucuauuagacuuagcgcuggaggcgauaucugggucacacgggagcccuauguguccugugacccugauaaaugcuaccaauucgcccuggggcagggaaccacacucaacaauggccauucuaacgacaccguucacgaucgcacgccguauagaacacugcugaugaaugaacucggggugcccuuucaucugggaacccggcaggucuguaucgccuggagcuccagcucuugccacgacggcaaggcuuggcuucauguguguguuacaggcgaugacgagaacgccaccgcuuccuucauuuacaaugggcgccugguggauagcaucggaucuugguccaagaaaauucucagaacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgguaccccggagugcgcugcguguguagagacaacuggaaaggcuccaaucggccuaucgucgauauuaacgugaaggacuacagcaucguuucuuccuaugugugcagcggccuggucggggacacaccccgcaagaaugauucuuucagcuccucucauugucucgacccgaacaaugaggaaggaggccacggggugaaaggaugggcuuuugaugacggcaacgauguuuggauggggagaaccauuagcgagaagcugcgguccggauacgagacguucaaagugaucgaaggcuggagcaagccuaauucuaaacugcagacaaaccgccaggucaucguggagagaggcaaucgguccggguauagcggaaucuuuucugucgaaggcaaguccugcauuaacagauguuucuacguggagcucauucgcgggcggaaagaagagaccgagguuugguggaccagcaauuccaucguggucuuuugcggaacacccggcaccuaugggacaggcucuuggccugacggagccgauauuaaccugaugcccaucuga

SEQ ID NO: 198339 - RNA, 1410 nt, Artificial Sequence; identical to SEQ ID NO: 197615
  derived and/or modified sequence opt5 from neuraminidase__InfluenzaA__ABI21038

SEQ ID NO: 198340 - RNA, 1410 nt, Artificial Sequence
  derived and/or modified sequence opt5 from neuraminidase__InfluenzaA__ABI21049
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuggcuacgucugcuccgggcuggugggagacacaccccggaagaaugauagcuucucuagcucccacugucucgacccgaacaaugaagagggcgggcauggaguuaaaggcugggccuuugaugacgggaacgauguguggaugggacgcaccauuucugaaaagcugagaagcggcuaugagacguucaaagucaucgagggcugguccaagccuaauagcaaacugcagaucaaccgccaggugauugucgaacgggggaauagaucuggauacuccggcaucuuuagcguggaggggaagucuugcauuaaccgguguuucuauguugaacucaucagaggacgcaaggaggaaacagaggugugguggaccuccaauagcauugucguguuuugcggcaccuccgggacauacggcaccggaucuuggcccgacggcgcugauaucaaccugaugccuauuuga

SEQ ID NO: 198341 - RNA, 1410 nt, Artificial Sequence
  derived and/or modified sequence opt5 from neuraminidase__InfluenzaA__ABI21060
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacccgucgaguaucggaauuggagcaagccucagugcaacaucaccggguucgcccccuuuuccaaagacaauucuauucgccugagcgcgggaggcgauaucugggugacaagagagccuuacguuuccugugacccggauaagugcuaucaauucgcucuugggcagggaaccacacugaacaauggccacucuaacgacaccgugcaugaucggacgcccuaccgcacacuccugaugaaugaacugggggucccuuuucaccucggaaccagacagguguguaucgccuggagcuccagcucuugccaugacggcaaggccuggcugcacguuugugugacaggcgaugacaaaaacgcuaccgccuccuucauuuauaaugggcggcuugucgauagcaucggaucuugguccaagaaaauucugcgcacccaggagagcgaaugcguguguaucaacggcacaugcacgguggucaugaccgacgggucugcuuccggaaaggccgauacaaaaauucucuuuaucgaggagggcaagaucguucacauuagcacccuguccgggucugcgcaacauguggaagagugcagcuguuaccccagauauccuggagugcggugcgucugucgcgacaacuggaagggcuccaauagacccaucguggauauuaacguuaaagacuacagcaucgugucuuccuacgucugcagcggccuugugggggacacaccgcggaagaaugauucuuucagcuccucucacugucuggacccuaacaaugaagagggaggccaugggguuaaaggaugggccuuugaugacggcaacgauguguggauggggcgcaccauuagcgaaaagcucagauccggauaugagacguucaaagucaucgagggcuggagcaagcccaauucuaaacugcagaucaaccgccaggugauugucgaacggggcaauagauccggguacagcggaaucuuuucuguggagggcaaguccugcauuaaccgguguuucuauguugaacugaucagagggcgcaaggaggaaacagaggugugguggaccagcaauuccauugucguguuuugcggaaccucuggcacauacgggaccggcagcuggccugacggagcugauaucaaccucaugcccauuuga

SEQ ID NO: 198342 - RNA, 1410 nt, Artificial Sequence
  derived and/or modified sequence opt5 from neuraminidase__InfluenzaA__ABI21071
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugauguccgaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauuguuagcucuuauguguguagcggacuugucggcgauacccccagaaagaaugacuccucuagcuccagccauugccuggauccgaacaaugaggaaggcgggcacggagugaaaggcugggccuucgacgaugggaacgacguuuggaugggacggacgaucucugagaagcuccgcuccggcuacgagacauuuaaagugaucgaaggguggagcaauccuaacucuaagcugcagauuaauagacaggucaucguggaucggggaaaccgcuccggcuauagcggcauuuucuccgucgaggggaaaucuuguaucaauagaugcuuuuacguggaacugauucggggaagaaaggaggaaaccgagguucucuggaccagcaacuccaucguggucuucuguggcacaucugggaccuauggaacaggcagcuggcccgacggggcugauauuaaucugaugccuaucuga

SEQ ID NO: 198343 - RNA, 1410 nt, Artificial Sequence
  derived and/or modified sequence opt5 from neuraminidase__InfluenzaA__ABI21082
augaaccccaaucagaagaucauuaccaucggcagcgugucccugacaauuucuacgaucugcuucuuuaugcaaauugccacccucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucacgaccggacaccguaucgcacccuccugaugaacgaacugggcgugcccuuucaucucgggacaaagcaggucugcaucgccugguccucuagcuccugucacgauggaaaagccuggcugcaugugugcguuaccggcgacgauaagaaugcuaccgccagcuucauuuacaacggcagacuuguggacucuaucgucuccuggagcaaagagauucugcggacacaggaaucugagugugugugcaucaaugggacguguaccguggucaugacagauggauccgcuagcggcaaggccgacaccaaaauucucuuuaucgaggaagggaagaucguucacacauccacccugucuggaagcgcgcaacacguggaggaaugcuccugcuauccucgcuaccccggcgugagaugugucugccgggauaacuggaaggggagcaaccgcccuauuguggacaucaauauuaaagacuacucuaucguuuccagcuauguguguucuggacuugucggcgauacgcccagaaagaacgacagcuccucuagcucccauugccuggauccgaauaacgaggaaggcgggcacggagugaaaggcugggccuucgacgaugggaaugacguuuggaugggacggacaauuagcgagaagcuccgcucuggcuacgagaccuuuaaagugaucgaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggacaucuaauagcauuguggucuucuguggcaccuccgggacauauggaacgggcucuuggcccgacggggcugauaucaaccugaugccuauuuga

SEQ ID NO: 198344 - RNA, 1410 nt, Artificial Sequence; identical to SEQ ID NO: 197760
  derived and/or modified sequence opt5 from neuraminidase__InfluenzaA__ABI21093

SEQ ID NO: 198345 - RNA, 1410 nt, Artificial Sequence
  derived and/or modified sequence opt5 from neuraminidase__InfluenzaA__ABI21104
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucuggcuaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucacgaccggaccccguaucgcacgcuccugaugaacgaacugggcgugcccuuucaucucgggacaaagcaggucugcauugccugguccucuagcuccugucacgauggaaaggcuuggcugcaugugugcguuaccggcgacgauaaaaaugccacagcuagcuucaucuacaacggcagacuuguggacucuauugucuccuggagcaaagagauccugcggacccaggaaucugagugugugugcauuaaugggaccuguacaguggucaugacggauggauccgccagcggcaaggcggacaccaaaauccucuuuaucgaggaagggaagauuguucacacauccacccugucuggaagcgcccaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacacccagaaagaacgacagcuccucuagcucccauugccuggauccgaauaacgaggaaggcgggcacggagugaaaggcugggcuuucgacgaugggaaugacguuuggaugggacggaccaucagcgagaagcuccgcucuggcuacgagacguuuaaagugaucgaagggugguccaacccuaauagcaagcugcagauuaacagacaggucaucguggaucggggaaaucgcucuggcuauuccggcauuuucagcgucgaggggaaaaacuguaucaauagaugcuuuuacguggaacugauucggggaagaaaggaggaaacagagguucucuggaccuccaacucuaucguggucuucuguggcaccagcgggacauauggaaccggcuccuggcccgacggggccgauauuaaucugaugccuaucuga

SEQ ID NO: 198346 - RNA, 1410 nt, Artificial Sequence; identical to SEQ ID NO: 197351
  derived and/or modified sequence opt5 from neuraminidase__InfluenzaA__ABI21115

SEQ ID NO: 198347 - RNA, 1410 nt, Artificial Sequence; identical to SEQ ID NO: 197351
  derived and/or modified sequence opt5 from neuraminidase__InfluenzaA__ABI21126

SEQ ID NO: 198348 - RNA, 1410 nt, Artificial Sequence; identical to SEQ ID NO: 197760
  derived and/or modified sequence opt5 from neuraminidase__InfluenzaA__ABI21137

SEQ ID NO: 198349 - RNA, 1410 nt, Artificial Sequence; identical to SEQ ID NO: 197351
  derived and/or modified sequence opt5 from neuraminidase__InfluenzaA__ABI21148

SEQ ID NO: 198350 - RNA, 1410 nt, Artificial Sequence
  derived and/or modified sequence opt5 from neuraminidase__InfluenzaA__ABI21159
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccggauauguguguagcggccuugucggcgauacccccagaaagaacgacucuagcuccucuagccauugccuggauccgaauaacgaggaagggggacacggcgugaaagggugggccuucgacgauggaaaugacguuuggaugggccggacgaucuccgagaagcuccgcagcggguacgagacauuuaaagugaucgaaggauggucuaacccuaauuccaagcugcagauuaacagacaggucaucguggaucggggcaaucgcagcggcuauucugggauuuucuccgucgagggaaaaagcuguaucaacagaugcuuuuacguggaacugauucggggcagaaaggaggaaaccgagguucucuggaccuccaauucuaucguggucuucugugggacaagcggaaccuauggcacaggguccuggcccgacggcgcugauauuaaccugaugccuaucuga

SEQ ID NO: 198351 - RNA, 1410 nt, Artificial Sequence; identical to SEQ ID NO: 197351
  derived and/or modified sequence opt5 from neuraminidase__InfluenzaA__ABI21170

SEQ ID NO: 198352 - RNA, 1410 nt, Artificial Sequence; identical to SEQ ID NO: 197351
  derived and/or modified sequence opt5 from neuraminidase__InfluenzaA__ABI21181

SEQ ID NO: 198353 - RNA, 1413 nt, Artificial Sequence
  derived and/or modified sequence opt5 from neuraminidase__InfluenzaA__ABI21192
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaccugcaaccagagaaucauuacauacgaaaauuccaccugggugaaccacacauaugucaauaucaacaauaccaacguuguggccggaaaagacaagacaucugugacccuggcgggcaauagcucccuuuguagcaucucugggugggcuauuuacacgaaagauaacuccauccggauuggaagcaagggcgacgucuucgugauccgcgagccuuuuauuucuugcucccaucuggaguguagaaccuucuuucucacacaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaaucggaaucagcggcccugacaacggggcggucgccgugcugaaauauaacggaauuaucaccgaaacgauuaagucuuggagaaaacggauccuccgcacacaggaguccgagugcguuugugugaauggcagcugcuuuaccauuaugacagauggccccucuaacggggcugccagcuacaagaucuucaaaaucgaaaagggaaaggucaccaaauccauugagcugaaugcuccuaacuuucacuaugaagaguguucuugcuacccggacaccggcacagugaugugugugugcagagauaauuggcacgggagcaaccggcccugggucuccuucaaucagaaccuugacuaccagaucggauauauuugcagcggcguuuuuggggauaauccucgccccaaggacggaaaaggcucuuguaacccugugacgguggauggcgccgacggggucaagggauucuccuacaaauauggcaaugggguguggaucggaagaaccaagagcaaccggcugcgcaaaggcuuugagaugauuugggaccccaauggguggacagauaccgacucugauuucuccguuaagcaagacguggucgcgaucacagauuggagcggcuacuccggaucuuuugugcagcauccggaacucaccggccuggacugcauuagaccuuguuucuggguugagcuugugcgggggcugccccgcgaaaacacgacaaucuggaccagcggauccucuaucagcuucugcggcgucgauuccgacaccgccaauuggagcuggccugauggggcugagcuccccuuuauuaucgacaaguga

SEQ ID NO: 198354 - RNA, 1413 nt, Artificial Sequence; identical to SEQ ID NO: 197410
  derived and/or modified sequence opt5 from neuraminidase__InfluenzaA__ABI21203

SEQ ID NO: 198355 - RNA, 1413 nt, Artificial Sequence
  derived and/or modified sequence opt5 from neuraminidase__InfluenzaA__ABI21214
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacauuaccucugugacacuggcgggcaauagcucccuuuguagcaucucugggugggcuauuuacaccaaggauaacuccauccggauuggaagcaaaggcgacgucuucgugauccgcgaaccuuuuaucucuugcucccaucuggaguguagaacguucuuucucacccaaggcgcccugcuuaaugauaagcacagcaacgggacaguuaaagaccggucuccguaucgcgcccugauguccugcccccucggagaagcuccuagccccuacaauuccaaguucgagucuguggccuggagcgcuuccgccugucaugauggcaugggguggcugaccauuggaaucagcggcccugacaacggggcggucgccgugcugaaguauaacggaauuaucacagaaaccauuaaaucuuggaagaaaagaauccuccggacgcaggaguccgagugcguuugugugaauggcagcugcuuuacaaucaugaccgauggccccucuaacggggcugccagcuacaagauuuucaaaaucgaaaagggaaaggucacaaaauccauugagcugaaugcuccuaacuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaggacggaaaaggcucuuguaacccugugacaguggauggcgccgacggggucaagggauucuccuacaaauauggcaaugggguguggaucggacgcacgaaguccaacagacugcggaaaggcuuugagaugauuugggaccccaauggguggaccgauacagacucugauuucuccguuaagcaagacguggucgcgaucaccgauuggagcggcuacuccggaucuuuugugcagcauccggaacucacaggccuggacugcauccgcccuuguuucuggguugagcuugugagagggcugccccgggaaaacaccacgauuuggacaagcggauccucuaucagcuucugcggcgucgauuccgacaccgccaauuggagcuggccugauggggcugagcuccccuuuaccauugacaaguga

SEQ ID NO: 198356 - RNA, 1410 nt, Artificial Sequence
  derived and/or modified sequence opt5 from neuraminidase__InfluenzaA__ABI21247
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaaaauguccuaagcuggccgaguaccggaauuggagcaaaccccagugcaagauuaccggguucgcgccuuuuuccaaggacaacucuauccgccuuagcgcuggaggcgauauuugggucacaagagagcccuauguguccugugacccugggaaaugcuaccaauucgcccugggacagggcaccacacucaauaaccggcauucuaaugauaccguucacgaccgcacgccguauagaacacugcugaugaacgaacucggggugcccuuucaucugggaaccaagcaggucuguaucgccuggagcuccagcucuugccacgauggcaaggcuuggcuucauguguguguuacaggccacgacgagaaugccaccgcuuccuucaucuacgaugggcggcugguggacagcauuggaucuugguccaaaaacauccuccgcacccaggaaagcgagugcgucuguauuaauggcacaugcacgguggugaugaccgaugggucugccuccgagagagcggacacaaaaauccuguuuauugaagagggaaagaucguccacaucagcccucuuuccggcucugcccaacauguugaagagugcagcuguuauccccgguacccuggggugcgcugcguguguagagauaacuggaagggauccaaccggcccauugucgacaucaaugugaaagaucacagcauuguuucuuccuacgugugcagcggccuggucggcgacaccccgcgcaagaacgacucuagcuccucuagcuauuguagaaauccuaacaaugaaaaagggucccauggaaugaagggcugggcuuucgaugacgggaacgauguguggaugggacggacaaucagcgaggagcuccgcucuggcuacgaaaccuuuaaaguuauugggggaugguccaagcccaauagcaaacugcagaucaacagacaggugaucgucgaccggggcaauagaucuggcuauuccgggauuuucagcguggagggaaaguccugcaucaaccgcuguuuuuacgucgaacugauucggggcagaaagcaggagacggaagugugguggacaucuaauagcaucguuguguucugcgggaccuccggaaccuauggcacagggucuuggccugauggcgccgacauuaaccucaugcccaucuga

SEQ ID NO: 198357 - RNA, 1410 nt, Artificial Sequence; identical to SEQ ID NO: 198277
  derived and/or modified sequence opt5 from neuraminidase__InfluenzaA__ABI21258

SEQ ID NO: 198358 - RNA, 1410 nt, Artificial Sequence; identical to SEQ ID NO: 198277
  derived and/or modified sequence opt5 from neuraminidase__InfluenzaA__ABI21269

SEQ ID NO: 198359 - RNA, 1410 nt, Artificial Sequence; identical to SEQ ID NO: 198277
  derived and/or modified sequence opt5 from neuraminidase__InfluenzaA__ABI21280

SEQ ID NO: 198360 - RNA, 1410 nt, Artificial Sequence; identical to SEQ ID NO: 198209
  derived and/or modified sequence opt5 from neuraminidase__InfluenzaA__ABI21302

SEQ ID NO: 198361 - RNA, 1410 nt, Artificial Sequence; identical to SEQ ID NO: 198209
  derived and/or modified sequence opt5 from neuraminidase__InfluenzaA__ABI21313

SEQ ID NO: 198362 - RNA, 1410 nt, Artificial Sequence; identical to SEQ ID NO: 198209
  derived and/or modified sequence opt5 from neuraminidase__InfluenzaA__ABI21324

SEQ ID NO: 198363 - RNA, 1410 nt, Artificial Sequence; identical to SEQ ID NO: 198209
  derived and/or modified sequence opt5 from neuraminidase__InfluenzaA__ABI21335

SEQ ID NO: 198364 - RNA, 1410 nt, Artificial Sequence; identical to SEQ ID NO: 198277
  derived and/or modified sequence opt5 from neuraminidase__InfluenzaA__ABI21346

SEQ ID NO: 198365 - RNA, 1410 nt, Artificial Sequence
  derived and/or modified sequence opt5 from neuraminidase__InfluenzaA__ABI21357
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucggggugcccuuucaucugggaaccaaacaggucuguaucgccuggagcuccagcucuugccacgauggcaaggcuuggcuucauguguguguuacaggccacgacgagaaugccaccgcuuccuucauuuacgaugggcggcugguggacagcaucggaucuugguccaaaaacauucuccgcacccaggaaagcgagugcgucuguaucaauggcacaugcacgguggugaugaccgaugggucugccuccgagagagcggacacaaagauucuguuuaucgaagagggaaaaaucguccacauuagcccucuuuccggcucugcccaacauguugaagagugcagcuguuauccccgguacccuggggugcgcugcguguguagagauaacuggaagggauccaaccggcccaucgucgacauuaaugugaagaacuacagcaucguuucuuccuaugugugcagcggccuggucggcgauaccccgcgcaaaaaugacucuagcuccucuagcuacuguagaaacccuaauaacgaaaaggggucccacggagugaaaggcugggcuuucgacgaugggaaugacguuuggaugggacggacaauuagcgaggagcuccgcucuggcuaugaaaccuuuaaggugaucgggggaugguccaaacccaacagcaagcugcagaucaauagacaggucauuguggaucggggcaacagaucuggcuacuccgggaucuucagcgucgagggaaaauccugcauuaaucgcuguuuuuauguggaacugauccggggcagaaagcaggaggccgaaguuugguggacgucuaacagcauuguggucuucugcgggacauccggaaccuacggcaccgggucuuggccugacggcgcugauaucaaucucaugcccauuuga

SEQ ID NO: 198366 - RNA, 1410 nt, Artificial Sequence; identical to SEQ ID NO: 198209
  derived and/or modified sequence opt5 from neuraminidase__InfluenzaA__ABI21368

SEQ ID NO: 198367 - RNA, 1410 nt, Artificial Sequence; identical to SEQ ID NO: 198209
  derived and/or modified sequence opt5 from neuraminidase__InfluenzaA__ABI21379

SEQ ID NO: 198368 - RNA, 1410 nt, Artificial Sequence; identical to SEQ ID NO: 198209
  derived and/or modified sequence opt5 from neuraminidase__InfluenzaA__ABI21390

SEQ ID NO: 198369 - RNA, 1410 nt, Artificial Sequence; identical to SEQ ID NO: 198277
  derived and/or modified sequence opt5 from neuraminidase__InfluenzaA__ABI21401

SEQ ID NO: 198370 - RNA, 1410 nt, Artificial Sequence
  derived and/or modified sequence opt5 from neuraminidase__InfluenzaA__ABI21412
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaaaaucaccggguucgcgcccuuuagcaaggacaacuccauucgccuuucugcuggaggcgauaucugggucacaagagagccuuaugugagcugugacccggggaagugcuaccaauucgcccugggacagggcaccacacucaauaaccggcauuccaaugauaccguucacgaccgcacgcccuauagaacacugcugaugaacgaacucggggugccuuuucaucugggaaccaaacaggucuguaucgccuggucuagcuccagcugccacgauggcaaggcuuggcuucauguguguguuacaggccacgacgagaaugccaccgcuucuuucauuuacgaugggcggcugguggacuccaucggaagcuggucuaaaaacauucuccgcacccaggaauccgagugcgucuguaucaauggcacaugcacgguggugaugaccgaugggagcgccucugagagagcggacacaaagauucuguuuaucgaagagggaaaaaucguccacauuagcccccuuuccggcuccgcccaacauguugaagagugcucuuguuauccucgguaccccggggugcgcugcguguguagagauaacuggaagggaagcaaccggccgaucgucgacauuaaugugaaggauuacuccaucguuagcucuuaugugugcuccggccuggucggcgacaccccucgcaaaaacgacagcucuagcuccucuuacuguagaaaucccaacaaugaaaaggggagccacggagugaaaggcugggcuuucgaugacgggaacgauguuuggaugggacggacaauuuccgaggagcuccgcagcggcuaugaaaccuuuaaggugaucgggggauggucuaaaccuaauuccaagcugcagaucaacagacaggucauuguggaccggggcaauagaagcggcuacucugggaucuucuccgucgagggaaaaagcugcauuaaccgcuguuuuuauguggaacugauccggggcagaaagcaggagacggaaguuugguggacauccaauucuauuguggucuucugcgggaccagcggaaccuacggcacaggguccuggcccgauggcgccgacaucaaccucaugcccauuuga

SEQ ID NO: 198371 - RNA, 1410 nt, Artificial Sequence; identical to SEQ ID NO: 197543
  derived and/or modified sequence opt5 from neuraminidase__InfluenzaA__ABI21423

SEQ ID NO: 198372 - RNA, 1410 nt, Artificial Sequence; identical to SEQ ID NO: 198209
  derived and/or modified sequence opt5 from neuraminidase__InfluenzaA__ABI21434

SEQ ID NO: 198373 - RNA, 1410 nt, Artificial Sequence; identical to SEQ ID NO: 198277
  derived and/or modified sequence opt5 from neuraminidase__InfluenzaA__ABI21445

SEQ ID NO: 198374 - RNA, 1410 nt, Artificial Sequence; identical to SEQ ID NO: 198277
  derived and/or modified sequence opt5 from neuraminidase__InfluenzaA__ABI21456

SEQ ID NO: 198375 - RNA, 1410 nt, Artificial Sequence; identical to SEQ ID NO: 198370
  derived and/or modified sequence opt5 from neuraminidase__InfluenzaA__ABI21467

SEQ ID NO: 198376 - RNA, 1410 nt, Artificial Sequence; identical to SEQ ID NO: 198277
  derived and/or modified sequence opt5 from neuraminidase__InfluenzaA__ABI21478

SEQ ID NO: 198377 - RNA, 1410 nt, Artificial Sequence; identical to SEQ ID NO: 198277
  derived and/or modified sequence opt5 from neuraminidase__InfluenzaA__ABI21489

SEQ ID NO: 198378 - RNA, 1410 nt, Artificial Sequence; identical to SEQ ID NO: 198277
  derived and/or modified sequence opt5 from neuraminidase__InfluenzaA__ABI21500

SEQ ID NO: 198379 - RNA, 1410 nt, Artificial Sequence
  derived and/or modified sequence opt5 from neuraminidase__InfluenzaA__ABI21511
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauguguccuaaacuggcggaguaccggaauuggagcaagccccagugcaacauuacgggguucgcuccuuuuuccaaagacaauucuauccgccuuagcgccggaggcgauauuugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucaucuacgaugggcggcugguggacagcauuggaucuugguccaaaaagauccuccgcacccaggaaagcgagugcgucuguauuaaugggaccugcacaguggugaugacggauggcucugcguccggaaaagccgacaccaagauccuguuuauugaggaaggcaaaaucgucaacaucagcacacuuuccgggucugcucaacacguugaggaaugcagcuguuauccuagauaccccggagugcggugcgugugucgcgauaacuggaagggcuccaauagaccuauugucgacaucaacgugaaggacuacagcauuguuucuuccuaugugugcagcggccuggucggggauacaccccggaaaaaugacucuuucagcuccucucacugucucgauccgaacaaugaggaaggaggccauggggugaagggaugggccuuugacgauggcaacgacguuuggauggggcgcaccaucagcgagaaacugagauccggauacgagaccuucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagacggagguuugguggacaagcaauuccaucguggucuuuugcggaaccucuggcaccuaugggacaggcagcuggcccgauggagcugacauuaaccugaugccuaucuga

SEQ ID NO: 198380 - RNA, 1413 nt, Artificial Sequence
  derived and/or modified sequence opt5 from neuraminidase__InfluenzaA__ABI21533
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugaugcgcgaaccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagagaauccuccggacgcaggaguccgagugcguuugugugaauggcagcugcuuuacaauuaugaccgauggccccucuaacggggcugccagcuacaaaaucuucaagaucgaaaagggaaaagucauuaaguccaucgagcugaaugcuccuaacucucacuaugaagaguguagcugcuacccggacacaggcaccgugaugugugugugccgcgauaauuggcacggguccaacagacccugggucagcuuuaaucagaaccuugacuaccagauuggauauaucugcucuggcguuuucggggauaauccucggcccaaagacggagagggcuccuguaacccugugaccguggauggcgccgacggggucaagggauuuagcuacaaauauggcaaugggguguggauuggacgcacaaagucuaacagacugcggaaaggcuucgaaaugaucugggaccccaauggguggacggauaccgacuccgauuuuagcguuaagcaagacguggucgcgauuacagauugguccggcuacucuggauccuucgugcagcauccggagcucaccggccuggacugcauccgcccuuguuuuuggguugaacuugugagagggcggccccgcgagaacacaaccaucuggacguccggaucuagcauuuccuucugcggcgucaauagcgauacagccaacuggucuuggccugacggggcugaacugcccuucaccaucgauaaguga

SEQ ID NO: 198381 - RNA, 1413 nt, Artificial Sequence; identical to SEQ ID NO: 198380
  derived and/or modified sequence opt5 from neuraminidase__InfluenzaA__ABI21544

SEQ ID NO: 198382 - RNA, 1413 nt, Artificial Sequence; identical to SEQ ID NO: 198380
  derived and/or modified sequence opt5 from neuraminidase__InfluenzaA__ABI21555

SEQ ID NO: 198383 - RNA, 1413 nt, Artificial Sequence; identical to SEQ ID NO: 198380
  derived and/or modified sequence opt5 from neuraminidase__InfluenzaA__ABI21566

SEQ ID NO: 198384 - RNA, 1413 nt, Artificial Sequence; identical to SEQ ID NO: 198380
  derived and/or modified sequence opt5 from neuraminidase__InfluenzaA__ABI21577

SEQ ID NO: 198385 - RNA, 1413 nt, Artificial Sequence
  derived and/or modified sequence opt5 from neuraminidase__InfluenzaA__ABI22112
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacgaaaucauuacagagaccaucaagucuuggaaaaagcggauucucagaacgcaggaguccgaaugcguuugugugaauggaagcugcuuuacaaucaugaccgauggccccucuaacggcgcugccagcuacaaaaucuucaagauugagaaggggaaagucacaaaguccaucgaacugaaugcuccuaacuuucacuaugaggaguguucuugcuacccggacaccggaaccgugaugugugugugccgcgauaauuggcacggcagcaacagacccugggucuccuucaaucagaaccuugacuaccagauuggguauaucugcagcggaguuuuuggcgauaauccucggcccaaagacgggaagggaucuuguaacccugugacaguggauggcgccgacggcgucaaaggguucuccuacaaguauggaaauggcguguggauugggcgcacgaaaagcaacagacugcggaagggauuugaaaugaucugggaccccaauggcuggaccgauacagacucugauuucuccguuaagcaagacguggucgcgauuaccgauuggagcggguacuccggcucuuuugugcagcauccggagcucacaggacuggacugcauccgcccuuguuucuggguugaacuugugagaggccugccccgggagaacaccacgaucuggacaagcggguccucuauuagcuucugcggagucgauuccgacaccgccaauuggagcuggccugauggcgcugaacuccccuuuaccaucgacaaauga

SEQ ID NO: 198386 - RNA, 1410 nt, Artificial Sequence
  derived and/or modified sequence opt5 from neuraminidase__InfluenzaA__ABI22162
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagaccaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggacaucuaacagcauuguggucuucuguggcaccuccgggacauauggaacgggcucuuggcccgauggggcugacaucgaucugaugccuauuuga

SEQ ID NO: 198387 - RNA, 1350 nt, Artificial Sequence
  derived and/or modified sequence opt5 from neuraminidase__InfluenzaA__ABI23981
augaaccccaaucagaagaucauuaccaucggcagcauuugcauggugaucgggauugucucccugaugcuccaaaucggaaacaugaucucuauuuggguuagccacuccauccagacaggcaaucagagacaggccgagucuauuagcaacacgaaauuccugaccgaaaaggcuguggccuccgugacacuugcgggaaauucuagccuguguccuaucuccgggugggcugucuacagcaaagacaacucuauucggaucggcucccgcggggauguguuuguuauuagagagccguucaucagcugcucucaucucgaaugucggaccuuuuuccugacacaaggagcccuucugaaugacaagcacuccaacggcaccgugaaagaucgcagccccuauagaacacucaugucuuccccugucggcgaggcccccagcccuuacaauucccgguuugaaucuguggcuuggagcgccuccgcuugccaugacgggaccagcuggcugacgaucggaauuucuggccccgauaacggggccguugcggugcugaaguauaauggaaucauuaccgacacaaucaaguccuggcgcaacaauauucucagaacccaggagagcgagugugccugcgucaacggcucuuguuucacagugaugaccgaugggccuagcaauggacaggcuuccuacaaaaucuuuaagauggaaaaaggcaagguggucaaaucuguugagcuggacgccccgaacuaucacuacgaagagugcagcuguuaucccgaugcuggcgagaucacgugcgugugucgggacaacuggcauggguccaaucgcccuugggugagcuucaaccagaaucuugaauaccaaauuggauacaucugcucuggcgucuuuggggauaaccccagaccuaaugacggaacaggcuccugcgggcccgugagccugaacggagccuauggcguuaagggcuucucuuuuaaguacgggaauggaguguggauuggccggaccaaauccacaaacagccgcuccggguucgagaugaucugggauccgaauggauggaccggcaccgacucuagcuuuuccgucaagcaggacauuguggcgaucacagauuggucuggguauagcggcuccuucguucagcacccugaacucacgggacuggacuguaucagacccugcuucuggguggagcuuauucggggccgcccuaaagaaagcaccaucuggacaucuggguccagcauuucuuuuuguggagucaacuccgauaccgugagcuggucuuggcccgacggcgccgagcugcccuucacaaucgauaaguga

SEQ ID NO: 198388 - RNA, 1410 nt, Artificial Sequence; identical to SEQ ID NO: 197351
  derived and/or modified sequence opt5 from neuraminidase__InfluenzaA__ABI26649

SEQ ID NO: 198389 - RNA, 1413 nt, Artificial Sequence; identical to SEQ ID NO: 198074
  derived and/or modified sequence opt5 from neuraminidase__InfluenzaA__ABI30370

SEQ ID NO: 198390 - RNA, 1410 nt, Artificial Sequence; identical to SEQ ID NO: 198125
  derived and/or modified sequence opt5 from neuraminidase__InfluenzaA__ABI30392

SEQ ID NO: 198391 - RNA, 1410 nt, Artificial Sequence; identical to SEQ ID NO: 197754
  derived and/or modified sequence opt5 from neuraminidase__InfluenzaA__ABI30403

SEQ ID NO: 198392 - RNA, 1410 nt, Artificial Sequence; identical to SEQ ID NO: 197754
  derived and/or modified sequence opt5 from neuraminidase__InfluenzaA__ABI30414

SEQ ID NO: 198393 - RNA, 1410 nt, Artificial Sequence; identical to SEQ ID NO: 197351
  derived and/or modified sequence opt5 from neuraminidase__InfluenzaA__ABI30425

SEQ ID NO: 198394 - RNA, 1410 nt, Artificial Sequence; identical to SEQ ID NO: 197351
  derived and/or modified sequence opt5 from neuraminidase__InfluenzaA__ABI30436

SEQ ID NO: 198395 - RNA, 1410 nt, Artificial Sequence; identical to SEQ ID NO: 197351
  derived and/or modified sequence opt5 from neuraminidase__InfluenzaA__ABI30447

SEQ ID NO: 198396 - RNA, 1410 nt, Artificial Sequence; identical to SEQ ID NO: 197351
  derived and/or modified sequence opt5 from neuraminidase__InfluenzaA__ABI30458

SEQ ID NO: 198397 - RNA, 1410 nt, Artificial Sequence; identical to SEQ ID NO: 197351
  derived and/or modified sequence opt5 from neuraminidase__InfluenzaA__ABI30469

SEQ ID NO: 198398 - RNA, 1410 nt, Artificial Sequence; identical to SEQ ID NO: 197351
  derived and/or modified sequence opt5 from neuraminidase__InfluenzaA__ABI30480

SEQ ID NO: 198399 - RNA, 1410 nt, Artificial Sequence
  derived and/or modified sequence opt5 from neuraminidase__InfluenzaA__ABI30491
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccaagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgagcugggcgugcccuuucaucucgggaccaaacaggucugcauugccugguccucuagcuccugucacgauggaaaggccuggcugcaugugugcguuacaggcgacgauaaaaaugcuaccgccagcuucaucuacaacggcagacuuguggacucuauugucuccuggagcaaggaaauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggaccucuaauagcaucguggucuucuguggcacauccgggaccuauggaacaggcucuuggcccgacggggcugauauuaaccugaugccuaucuga

SEQ ID NO: 198400 - RNA, 1410 nt, Artificial Sequence; identical to SEQ ID NO: 197351
  derived and/or modified sequence opt5 from neuraminidase__InfluenzaA__ABI30502

SEQ ID NO: 198401 - RNA, 1410 nt, Artificial Sequence
  derived and/or modified sequence opt5 from neuraminidase__InfluenzaA__ABI30513
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagaccaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggacaucuaauagcauuguggucuucuguggcaccuccgggacauauggaacgggcucuuggcccgacggggcugauaucaaccugaugccuauuuga

SEQ ID NO: 198402 - RNA, 1410 nt, Artificial Sequence; identical to SEQ ID NO: 197351
  derived and/or modified sequence opt5 from neuraminidase__InfluenzaA__ABI30524

SEQ ID NO: 198403 - RNA, 1410 nt, Artificial Sequence; identical to SEQ ID NO: 197351
  derived and/or modified sequence opt5 from neuraminidase__InfluenzaA__ABI30535

SEQ ID NO: 198404 - RNA, 1410 nt, Artificial Sequence
  derived and/or modified sequence opt5 from neuraminidase__InfluenzaA__ABI30546
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaaccuccauagcaaugauaccgugcacgaccggacgccguaucgcacacugcugauguccgaacucggcguucccuuucaucuggggaccaaacaggugugcauugccuggucuagcuccagcugucacgauggaaaggccuggaugcaugucugcgugacaggcgacgauaagaacgcuaccgccucuuucaucuacaauggcagacuuguugacuccauugugagcuggucuaaagagauccugcggacccaggaauccgagugugucugcauuaacgggacauguacgguggugaugaccgauggaagcgcuuccggcaaggccgacacaaaaauccucuuuaucgaggaagggaagauuguccacaccucuacacugagcggauccgcgcaacacguugaggaaugcagcugcuauccucgcuaccccggcgugagaugugugugccgggauaauuggaaggggucuaaccgcccuaucgucgacauuaacaucaaagacuacuccauugugagcucuuauguuuguagcggacuugugggcgauacccccagaaagaaugacuccucuagcuccagccauugccuggauccgaacaaugaggaaggcgggcacggagucaaaggcugggccuucgacgaugggaacgacguguggaugggacggacgaucucugagaagcuccgcuccggcuacgagacauuuaaaguuaucgaaggguggagcaauccuaacucuaagcugcagauuaauagacaggugaucgucgaucggggaaaccgcuccggcuauagcggcauuuucuccguggaggggaaaaauuguaucaacagaugcuuuuacgucgaacugauucggggaagaaaggaggaaaccgaggugcucuggaccucuaauagcaucguuguguucuguggcacauccgggaccuauggaacaggcucuuggcccgacggggcugauauuaaccugaugccuaucuga

SEQ ID NO: 198405 - RNA, 1410 nt, Artificial Sequence; identical to SEQ ID NO: 197351
  derived and/or modified sequence opt5 from neuraminidase__InfluenzaA__ABI30557

SEQ ID NO: 198406 - RNA, 1410 nt, Artificial Sequence; identical to SEQ ID NO: 197738
  derived and/or modified sequence opt5 from neuraminidase__InfluenzaA__ABI30579

SEQ ID NO: 198407 - RNA, 1410 nt, Artificial Sequence
  derived and/or modified sequence opt5 from neuraminidase__InfluenzaA__ABI30590
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaagggauguaucaacagaugcuuuuacguggagcugauucggggcagaaaggaagagaccgaaguucucuggaccuccaauucuaucguggucuucugugggacaagcggaaccuauggcacaggguccuggcccgacggcgcugauauuaaccugaugccuaucuga

SEQ ID NO: 198408 - RNA, 1410 nt, Artificial Sequence; identical to SEQ ID NO: 197831
  derived and/or modified sequence opt5 from neuraminidase__InfluenzaA__ABI30601

SEQ ID NO: 198409 - RNA, 1410 nt, Artificial Sequence
  derived and/or modified sequence opt5 from neuraminidase__InfluenzaA__ABI30612
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuauccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuauugaagggugguccaauccuaacagcaagcugcagaucaauagacaggugauugucgaccggggaaaccgcucuggcuauuccggcaucuucagcguggaggggaaauccuguauuaauagaugcuuuuacgucgaacugauccggggaagaaaggaggaaaccgaggugcucuggaccucuaacagcauuguuguguucuguggcacauccgggaccuauggaacaggcucuuggcccgauggggcugacaucaaucugaugccuaucuga

SEQ ID NO: 198410 - RNA, 1410 nt, Artificial Sequence; identical to SEQ ID NO: 197831
  derived and/or modified sequence opt5 from neuraminidase__InfluenzaA__ABI30623

SEQ ID NO: 198411 - RNA, 1410 nt, Artificial Sequence
  derived and/or modified sequence opt5 from neuraminidase__InfluenzaA__ABI30736
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuguuguguccagcuaugucuguucuggacuugugggcgauacccccagaaagaacgacagcuccucuagcucccauugccuggauccgaauaacgaagagggcgggcacggaguuaaaggcugggccuucgacgaugggaaugacguguggaugggacggacgauuagcgaaaaacuccgcucuggcuacgagacauuuaaggucaucgaggggugguccaacccuaauagcaaacugcagaucaacagacaggugauugucgaucggggaaaucgcucuggcuauuccggcaucuucagcguggaagggaaguccuguauuaacagaugcuuuuacguugagcugauccggggaagaaaggaagagaccgaagugcucuggaccucuaauagcauugucguguucuguggcacauccgggaccuauggaacaggcucuuggcccgacggggcugauaucaaccugaugccuauuuga

SEQ ID NO: 198412 - RNA, 1410 nt, Artificial Sequence
  derived and/or modified sequence opt5 from neuraminidase__InfluenzaA__ABI30758
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuaugaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaaugauaccguucacgaccggacgccguaccgcacacuccugaugaacgaacugggcgugcccuuucaucucgggaccaagcaggucuguauugccugguccucuagcuccugccacgauggaaaagccuggcugcauguguguguuacaggcgacgauaagaaugcuaccgccagcuucaucuauaacggcagacuuguggacucuauugucuccuggagcaaaaagauccugcggacccaggagucugaaugcguguguauuaaugggacaugcacgguggucaugaccgauggauccgcuagcggcaaagccgacacaaagauccucuuuaucgaggaggggaagauuguucacaccuccacacugucuggaagcgcgcaacacguggaagaguguuccugcuacccucgcuaccccggcgugagaugcgucugucgggauaacuggaaagggagcaaccgcccuaucguggacauuaauaucaaggacuauucuauuguuuccagcuacgugugcucuggacuugucggcgauacccccagaaagaacgacagcuccucuagcucccauugucuggauccgaauaacgaagagggcgggcacggagugaaaggcugggccuucgacgaugggaaugacguuuggaugggacggacgaucagcgaaaaacuccgcucuggcuaugagacauuuaaggugaucgaggggugguccaacccuaauagcaaacugcagauuaacagacaggucaucguggaucggggaaaucgcucuggcuacuccggcauuuucagcgucgaagggaaguccugcaucaacagauguuuuuauguggagcugauucggggaagaaaggaagagaccgaaguucucuggaccucuaauagcaucguggucuucugcggcacauccgggaccuacggaacaggcucuuggcccgacggggcugauauuaaccugaugccuaucuga

SEQ ID NO: 198413 - RNA, 1410 nt, Artificial Sequence; identical to SEQ ID NO: 197738
  derived and/or modified sequence opt5 from neuraminidase__InfluenzaA__ABI30769

SEQ ID NO: 198414 - RNA, 1410 nt, Artificial Sequence; identical to SEQ ID NO: 197738
  derived and/or modified sequence opt5 from neuraminidase__InfluenzaA__ABI30780

SEQ ID NO: 198415 - RNA, 1410 nt, Artificial Sequence; identical to SEQ ID NO: 197738
  derived and/or modified sequence opt5 from neuraminidase__InfluenzaA__ABI30791

SEQ ID NO: 198416 - RNA, 1410 nt, Artificial Sequence; identical to SEQ ID NO: 197738
  derived and/or modified sequence opt5 from neuraminidase__InfluenzaA__ABI30802

SEQ ID NO: 198417 - RNA, 1410 nt, Artificial Sequence; identical to SEQ ID NO: 197738
  derived and/or modified sequence opt5 from neuraminidase__InfluenzaA__ABI30813

SEQ ID NO: 198418 - RNA, 1410 nt, Artificial Sequence; identical to SEQ ID NO: 197738
  derived and/or modified sequence opt5 from neuraminidase__InfluenzaA__ABI30824

SEQ ID NO: 198419 - RNA, 1410 nt, Artificial Sequence; identical to SEQ ID NO: 197738
  derived and/or modified sequence opt5 from neuraminidase__InfluenzaA__ABI30835

SEQ ID NO: 198420 - RNA, 1410 nt, Artificial Sequence; identical to SEQ ID NO: 197738
  derived and/or modified sequence opt5 from neuraminidase__InfluenzaA__ABI30846

SEQ ID NO: 198421 - RNA, 1410 nt, Artificial Sequence; identical to SEQ ID NO: 198209
  derived and/or modified sequence opt5 from neuraminidase__InfluenzaA__ABI30857

SEQ ID NO: 198422 - RNA, 1410 nt, Artificial Sequence; identical to SEQ ID NO: 198209
  derived and/or modified sequence opt5 from neuraminidase__InfluenzaA__ABI30868

SEQ ID NO: 198423 - RNA, 1350 nt, Artificial Sequence
  derived and/or modified sequence opt5 from neuraminidase__InfluenzaA__ABI36157
augaaccccaaucagaagaucauuaccaucggcagcauuugcauggccaucgggacagugucccugaugcuccaaauuggaaacaugaucucuaucugggucagccacuccauucagacgggcaaucagcaucaggcugagucuaucagcaacaccaauccucugacagaaaaagccguugcguccgugacccuugcugggaacucuagccuguguccgauuagaggaugggccgugcacuccaaggacaauagcauccggauuggcucuaaaggggaugucuucgugauccgcgagcccuuuauuuccugcagccauucugaauguagaacauucuuucucacccaaggagcccugcuuaacgacaagcacuccaaugagacaguuaaagaucggagcccucaucgcacccugaugucuugccccgugggcgaagcuccuucccccuacaacagcagauucgaguccgucgccuggucugcuagcgccugucacgacggcacguccuggcucaccaucgggaucagcggaccugauaauggcgcgguggccguucugaaguauaacgggauuaucacagacaccauuaagucuuggcggaauaacauccugcgcacacaggaguccgaaugcgcuugugugaauggaagcugcuuuaccgucaugacggauggcccgucuaacgggcaggccagcuacaaaauuuucaagauggagaaaggaaagguggugaaauccgucgaacucgacgcucccaacuaucacuacgaggaguguucuugcuauccugaugccggcgaaaucacauguguuugcagagacaauuggcauggcagcaaccggcccuggguguccuuuaaucagaaccuggaguaccaaaucggguauauuugcagcggaguguucggcgauaauccucgccccaacgacgggaccggaucuuguggcccgauguccagcaauggggcguacggagucaagggcuuuucuuucaaguacggcaacgggguguggaucggaagaacaaaauccaccaauagccgguccggcuuugaaaugauuugggauccuaacggguggaccggaacagacucuagcuucuccguuaagcaggacaucguggccauuacggauuggucuggcuauagcggguccuuuguccagcaccccgagcuuaccggccuggacugcauccgcccuuguuucuggguggaacucaucagaggacggcccaaagagagcacaauuuggaccucuggcuccagcaucucuuucugcgggguuaauuccgauacagugagcuggucuuggcccgacggagcugagcugccuuuuaccauugauaaguga

SEQ ID NO: 198424 - RNA, 1350 nt, Artificial Sequence; identical to SEQ ID NO: 198423
  derived and/or modified sequence opt5 from neuraminidase__InfluenzaA__ABI36168

SEQ ID NO: 198425 - RNA, 1350 nt, Artificial Sequence; identical to SEQ ID NO: 198423
  derived and/or modified sequence opt5 from neuraminidase__InfluenzaA__ABI36179

SEQ ID NO: 198426 - RNA, 1350 nt, Artificial Sequence; identical to SEQ ID NO: 198423
  derived and/or modified sequence opt5 from neuraminidase__InfluenzaA__ABI36189

SEQ ID NO: 198427 - RNA, 1350 nt, Artificial Sequence
  derived and/or modified sequence opt5 from neuraminidase__InfluenzaA__ABI36278
augaaccccaaucagaagaucauuaccaucggcagcauuugcauggugaucgggauugucucccugaugcuccaaaucggaaacaugaucucuauuuggguuagccacuccauccagaaaggcaaucagcaucaggccgagucuauuagcaacacaaauccucugacggaaaaggcuguggccuccgugacccuugcggggaacucuagccuguguccgaucagaggaugggcuguccacuccaaagacaauaacauucggaucggcagcaagggggauguguucguuauucgcgagcccuuuaucucuugcucccaucucgaauguagaacauucuuucugacccaaggagcccuucugaaugacaaacacagcaacggcacagugaaggaucggucuccucaucgcacccucauguccugccccgucggcgaggccccuagccccuacaauucuagauucgaauccguggcuuggagcgccuccgcuugucacgacgggacaucuuggcugaccaucggaauuagcggcccugauaacgaggccguugcggugcugaaguauaaugggaucauuacggacaccaucaaauccuggcggaacaauauucuccgcacacaggagagcgaaugcgccugugucaacggaucuugcuuuaccgugaugacagauggcccguccaacgggcaggcuagcuacaagaucuucaaaauggagaagggaaaaguggucaagucuguugaacuggacgcccccaauuaucacuacgaggaguguagcugcuauccugaugcuggcgaaaucaccugugugugcagagacaacuggcauggcuccaaucggcccugggugucuuuuaaccagaaucuugaguaccaaauuggguauaucugcagcggagucuucggcgauaacccucgccccaaugacgggacgggauccuguggcccgaugagcccuaacggggccuacggagugaagggcuuuucuuucaaauacggcaaugggguuuggauuggaagaacaaaguccaccaacagccggucuggcuuugaaaugaucugggaucccaauggguggacaggaaccgacuccagcuucuccgugaaacaggacauugucgcgaucaccgauuggucuggcuauagcggguccuuugugcagcacccugagcugacaggccucgacugcauccgccccuguuucuggguugaacugauuagaggacggcccaaggagucuacgaucuggaccagcggcuccagcauuucuuucugcggggugaacuccgauacagucagcuggucuuggccugacggagccgagcuuccguuuaccaucgauaaauga

SEQ ID NO: 198428 - RNA, 1350 nt, Artificial Sequence; identical to SEQ ID NO: 198427
  derived and/or modified sequence opt5 from neuraminidase__InfluenzaA__ABI36287

SEQ ID NO: 198429 - RNA, 1350 nt, Artificial Sequence; identical to SEQ ID NO: 198427
  derived and/or modified sequence opt5 from neuraminidase__InfluenzaA__ABI36298

SEQ ID NO: 198430 - RNA, 1350 nt, Artificial Sequence
  derived and/or modified sequence opt5 from neuraminidase__InfluenzaA__ABI36314
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaacucuuggcugaccaucggaauuagcggcccugauaaugaggccguugcggugcugaaguauaacgggaucauuacggacaccaucaaguccuggcggaauaacauucuccgcacacaggagagcgaaugcgccugugucaacggaucuugcuuuaccgugaugacagauggcccguccaaugggcaggcuagcuacaaaaucuucaagauggagaaaggaaagguggucaaaucuguugaacuggacgcccccaacuaucacuacgaggaguguagcugcuauccugaugcuggcgaaaucaccugugugugcagagacaauuggcauggcuccaaccggcccugggugucuuuuaaucagaaccuugaguaccaaauuggguauaucugcagcggagucuucggcgauaauccucgccccaacgacgggacgggauccuguggcccgaugagcccuaauggggccuacggagugaagggcuuuucuuucaaguacggcaacgggguuuggauuggaagaacaaaauccaccaauagccggucuggcuuugaaaugaucugggaucccaacggguggacaggaaccgacuccagcuucuccgugaagcaggacauugucgcgaucaccgauuggucuggcuauagcggguccuuugugcagcacccugagcugacaggccucgacugcauccgccccuguuucuggguugaacugauuagaggacggcccaaagagucuacgaucuggaccagcggcuccagcauuucuuucugcggggucaauuccgauacagugagcuggucuuggccugacggagccgagcuuccguuuaccaucgauaaguga

SEQ ID NO: 198431 - RNA, 1350 nt, Artificial Sequence
  derived and/or modified sequence opt5 from neuraminidase__InfluenzaA__ABI36336
augaaccccaaucagaagaucauuaccaucggcagcauuugcauggugaucgggauugucucccugaugcuccaaaucggaaacaugaucucuauuuggguuagccacuccgugcagacaggcaaucagcaucaggccgagucuaucagcaacacgaauccucugaccgaaaaagcuguggccuccgucacacuugcggggaacucuagccuguguccgauuagaggaugggcugugcacuccaaggacaauaacauccggauuggcagcaaaggggauguuuucgugauccgcgagcccuuuauuucuugcucccaucucgaauguagaaccuucuuucugacacaaggagcccuucugaaugacaagcacagcaacggcaccgucaaagaucggucuccucaucgcacacucauguccugcccccugggcgaggccccuagccccuacaauucuagauucgaauccgugagcugguccgcuucugccugucacgacgggaccagcuggcugacgaucggaaucuccggcccugauaacgaggcuguugccgugcucaaguauaaugggauuaucaccgacacaauuaagagcuggcggaacaauauccugcgcacccaggagucugaaugcgcgugugucaacggauccugcuuuacagugaugaccgauggcccgagcaacgggcaggccucuuacaaaauuuucaagauggagaaaggaaagguggucaaaagcguugaacuugacgcucccaauuaucacuacgaggaguguuccugcuauccugaugccggcgaaaucacgugugugugcagagacaacuggcauggcucuaaucggcccugggugagcuuuaaccagaaucuggaguaccaaaucggguauauuugcuccggagucuucggcgauaacccucgccccaaugacgggacaggaagcuguggcccgaugucuccuaacggggcuuacggagugaagggcuuuuccuucaaguacggcaaugggguuuggaucggaagaaccaaaagcacaaacucucgguccggcuuugaaaugauuugggaucccaauggguggaccggaaccgacagcuccuucucugugaagcaggacaucgucgccauuacagauuggagcggcuauuccgggucuuuugugcagcacccugagcucacgggccuggacugcauccgccccuguuucuggguugaacuuaucagaggacggcccaaagagagcaccauuuggacauccggcagcaucauuucuuucugcggggugaacuccgauaccgucagcuggucuuggccugacggagcggagcugccguuuacaaucgauaaguga

SEQ ID NO: 198432 - RNA, 1350 nt, Artificial Sequence
  derived and/or modified sequence opt5 from neuraminidase__InfluenzaA__ABI36358
augaaccccaaucagaagaucauuaccaucggcagcauuugcauggugaucgggauugucucccugaugcuccaaaucggaaacaugaucucuauuuggguuagccacuccgugcagacaggcaaucagcaucaggccgagucuaucagcaacacgaauccucugaccgaaaaagcuguggccuccgucacacuugcggggaacucuagccuguguccgauuagaggaugggcugugcacuccaaggacaauaacauccggauuggcagcaaaggggauguuuucgugauccgcgagcccuuuauuucuugcucccaucucgaauguagaaccuucuuucugacacaaggagcccuucugaaugacaagcacagcaacggcaccgucaaagaucggucuccucaucgcacacucauguccugccccgugggcgaggccccuagccccuacaauucuagauucgaauccguugcuuggagcgccuccgcuugucacgacgggaccucuuggcugacgaucggaaucagcggcccugauaacgaggccguggcgguccugaaguauaaugggauuaucaccgacacaauuaaguccuggcggaacaauauccuccgcacccaggagagcgaaugcgccugugugaacggaucuugcuuuacagugaugaccgauggcccguccaacgggcaggcuagcuacaaaauuuucaagauggagaaaggaaaggucguuaaaucuguggaacuggacgcccccaauuaucacuacgaggaguguagcugcuauccugaugcuggcgaaaucacgugugugugcagagacaacuggcauggcuccaaucggcccugggucucuuuuaaccagaaucuugaguaccaaaucggguauauuugcagcggaguguucggcgauaacccucgccccaaugacgggacaggauccuguggcccgaugagcccuaacggggccuacggaguuaagggcuuuucuuucaaguacggcaaugggguguggaucggaagaaccaaauccacaaacagccggucuggcuuugaaaugauuugggaucccaauggguggaccggaaccgacuccagcuucuccgucaagcaggacaucguggcgauuacagauuggucuggcuauagcggguccuuuguucagcacccugagcugacgggccucgacugcauccgccccuguuucuggguggaacugaucagaggacggcccaaagagucuaccauuuggacaagcggcuccagcaucucuuucugcggggucaacuccgauaccgugagcuggucuuggccugacggagccgagcuuccguuuacaauugauaaguga

SEQ ID NO: 198433 - RNA, 1350 nt, Artificial Sequence; identical to SEQ ID NO: 198423
  derived and/or modified sequence opt5 from neuraminidase__InfluenzaA__ABI36369

SEQ ID NO: 198434 - RNA, 1350 nt, Artificial Sequence
  derived and/or modified sequence opt5 from neuraminidase__InfluenzaA__ABI36391
augaaccccaaucagaagaucauuaccaucggcagcauuugcauggugaucgggauugucucccugaugcuccaaaucggaaacaugaucucuauuuggguuagccacuccacacagaaaggcaaucagcaucaggccgagucuaucagcaacacgaauccucugaccgaaaaggcuguggccuccgugacacuugcggggaacucuagccuguguccgauuagaggaugggcuguccacuccaaagacaauaacauccggauuggcagcaagggggauguguucguuauccgcgagcccuuuauuucuugcucccaucucgaauguagaaccuucuuucugacacaaggagcccuucugaaugacaaacacagcaacggcaccgugaaggaucggucuccucaucgcacacucauguccugccccgucggcgaggccccuagccccuacaauucuagauucgaauccguggcuuggagcgccuccgcuugucacgacgggaccucuuggcugacgaucggaaucagcggcccugauaacgaggccguugcggugcugaaguauaaugggauuaucaccgacacaauuaaauccuggcggaacaauauccuccgcacccaggagagcgaaugcgccugugucaacggaucuugcuuuacagugaugaccgauggcccguccaacgggcaggcuagcuacaagauuuucaaaauggagaagggaaaaguggucaagucuguugaacuggacgcccccaauuaucacuacgaggaguguagcugcuauccugaugcuggcgaaaucacgugugugugcagagacaacuggcauggcuccaaucggcccugggugucuuuuaaccagaaucuugaguaccaaaucggguauauuugcagcggaaucuucggcgauaacccucgccccaaugacgggacaggauccuguggcccgauguuuccuaacggggccuacggagucaagggcuucagcuuuaaauacggcaaugggguguggauuggaagaaccaagucuacaaacucccggagcggcuucgaaaugaucugggaucccaauggguggaccggaaccgacucuuccuuuagcguuaaacaggacauuguggcgaucacagauugguccggcuauucugggagcuucguccagcacccugagcugacgggccucgacugcauccgccccuguuucuggguggaacugauuagaggacggcccaaggaguccaccaucuggacaucuggcagcuccauuagcuuuugcgggguuaacucugauaccguguccuggagcuggccugacggagccgagcuuccguucacaaucgauaaauga

SEQ ID NO: 198435 - RNA, 1350 nt, Artificial Sequence; identical to SEQ ID NO: 198434
  derived and/or modified sequence opt5 from neuraminidase__InfluenzaA__ABI36402

SEQ ID NO: 198436 - RNA, 1350 nt, Artificial Sequence; identical to SEQ ID NO: 198423
  derived and/or modified sequence opt5 from neuraminidase__InfluenzaA__ABI36413

SEQ ID NO: 198437 - RNA, 1350 nt, Artificial Sequence
  derived and/or modified sequence opt5 from neuraminidase__InfluenzaA__ABI36446
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaccucuuggcugacgaucggaauuagcggcccugauaacgaggccguugcggugcugaaguauaaugggaucauuaccgacacaaucaaguccuggcggaacaauauucuccgcacccaggagagcgaaugcgccugugucaacggaucuugcuuuacagugaugaccgauggcccguccaacgggcaggcuagcuacaaaaucuucaagauggagaaaggaaagguggucaaaucuguugaacuggacgcccccaauuaucacuacgaggaguguagcugcuauccugaugcuggcgaaaucacgugugugugcagagacaacuggcauggcuccaaucggcccuggauuucuuuuaaccagaaucuugaguaccaaaucggguauauuugcagcggaguguucggcgauaacccucgccccaaugacgggacaggauccuguggcccgaugagcccuaacggggccuacggagucaagggcuuuucuuucaaguacggcaaugggguguggaucggaagaaccaaauccacaaacagccggucuggcuuugaaaugauuugggaucccaauggguggaccggaaccgacuccagcuucuccguuaagcaggacaucguggcgaucacagauuggucuggcuauagcggguccuuuguccagcacccugagcugacgggccucgacugcauucgccccuguuucuggguggaacugaucagaggacggcccaaagagucuaccauuuggacaagcggcuccagcaucucuuucugcgggguuaacuccgauaccgugagcuggucuuggccugacggagccgagcuuccguuuacaauugauaaguga

SEQ ID NO: 198438 - RNA, 1350 nt, Artificial Sequence; identical to SEQ ID NO: 198427
  derived and/or modified sequence opt5 from neuraminidase__InfluenzaA__ABI36457

SEQ ID NO: 198439 - RNA, 1350 nt, Artificial Sequence
  derived and/or modified sequence opt5 from neuraminidase__InfluenzaA__ABI36476
augaaccccaaucagaagaucauuaccaucggcagcauuugcauggugaucgggauugucucccugaugcuccaaaucggaaacaugaucucuauuuggguuagccacuccacacagaaaggcaaucagcaucaggccgagucuaucagcaacacgaauccucugaccgaaaaggcuguggccuccgugacacuugcggggaacucuagccuguguccgauuagaggaugggcuguccacuccaaagacaauaacauccggauuggcagcaagggggauguguucguuauccgcgagcccuuuauuucuugcucccaucucgaauguagaaccuucuuucugacacaaggagcccuucugaaugacaaacacagcaacggcaccgugaaggaucggucuccucaucgcacacucauguccugccccgucggcgaggccccuagccccuacaauucuagauucgaauccguggcuuggagcgccuccgcuugucacgacgggaccucuuggcugacgaucggaaucagcggcccugauaacgaggccguugcggugcugaaguauaaugggauuaucaccgacacaauuaaauccuggcggaacaauauccuccgcacccaggagagcgaaugcgccugugucaacggaucuugcuuuacagugaugaccgauggcccguccaacgggcaggcuagcuacaagauuuucaaaauggagaagggaaaaguggucaagucuguugaacuggacgcccccaauuaucacuacgaggaguguagcugcuauccugaugcuggcgaaaucacgugugugugcagagacaacuggcauggcuccaaucggcccugggugucuuuuaaccagaaucuugaguaccaaaucggguauauuugcagcggagucuucggcgauaacccucgccccaaugacgggacaggauccuguggcccgaugagcccuaacggggccuacggagugaagggcuuuucuuucaaauacggcaaugggguuuggaucggaagaaccaaguccacaaacagccggucuggcuuugaaaugauuugggaucccaauggguggaccggaaccgacuccagcuucuccgugaaacaggacaucgucgcgauuacagauuggucuggcuauagcggguccuuugugcagcacccugagcugacgggccucgacugcauccgccccuguuucuggguugaacugaucagaggacggcccaaggagucuaccauuuggacaagcggcuccagcaucucuuucugcggggugaacuccgauaccgucagcuggucuuggccugacggagccgagcuuccguuuacaauugauaaauga

SEQ ID NO: 198440 - RNA, 1350 nt, Artificial Sequence
  derived and/or modified sequence opt5 from neuraminidase__InfluenzaA__ABI49409
augaaccccaauagaaagaucauuaccaucggcagcauuugcauggugaucgggauggucucccugaugcuccagauuggaaacaugaucucuaucuggguuagccacuccauucaaacaggcaaucagcaucaggccgagucuaucagcaacacgaauccucugaccgaaaaagcuguggccuccgugacacuugcggggaacucuagccuguguccgauucggggaugggcuguccacuccaaggacaauaacauccgcauuggcagcaaaggggauguguucguuaucagagagcccuuuauuucuugcucccaucucgaaugucggaccuucuuucugacacagggagcccuucugaaugacaagcacagcaacggcaccgugaaagaucgcucuccucauagaacacucauguccugccccgucggcgaggccccuagccccuacaauucucgguucgaauccguggcuuggagcgccuccgcuugucacgacgggaccucuuggcugacgaucggaaucagcggcccugauaacgaggccguugcggugcugaaguauaaugggauuaucaccgacacaauuaaguccuggcgcaacaauauccucagaacccaagagagcgaaugcgccugugucaacggaucuugcuuuacagugaugaccgauggcccguccaacgggcaggcuagcuacaaaauuuucaagauggagaaaggaaagguggucaaaucuguugaacugguggcccccaauuaucacuacgaggaguguagcugcuauccugacgcuggcgaaaucacgugugugugccgggauaacuggcauggcuccaaucgccccugggucucuuuuaaccagaaucuugaguaccagaucggguauauuugcagcggaguguucggcgacaacccuagacccaaugaugggacaggauccuguggcccgaugagcccuaacggggccuacggaguuaagggcuuuucuuucaaguacggcaaugggguguggaucggacggaccaaauccacaaacagccgcucuggcuuugaaaugauuugggaccccaauggguggaccggaaccgauuccagcuucuccgucaagcaagacaucguggcgauuacagacuggucuggcuauagcggguccuuuguucagcacccugagcugacgggccucgauugcaucagacccuguuucuggguggaacugauccggggacgccccaaagagucuaccauuuggacaagcggcuccagcaucucuuucugcggggucaacuccgacaccgccagcuggucuuggccugauggagcugagcuuccguuuacaauugacaaguga

SEQ ID NO: 198441 - RNA, 1350 nt, Artificial Sequence
  derived and/or modified sequence opt5 from neuraminidase__InfluenzaA__ABI49417
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacggggagcccuucugaaugacaagcacagcaacggcaccgugaaagaucgcucuccucauagaacacucauguccugccccgucggcgaggccccuagccccuacaauucucgguucgaauccguggcuuggagcgccuccgcuugucacgacgggaccucuuggcugacgaucggaauuagcggcccugauaacgaggccguugcggugcugaaguauaaugggaucauuaccgacacaaucaaguccuggcgcaacaauauucucagaacccaagagagcgaaugcgccugugucaacggaucuugcuuuacagugaugaccgauggcccguccaacgggcaggcuagcuacaaaaucuucaagauggagaaaggaaagguggucaaaucuguugaacuggacgcccccaauuaucacuacgaggaguguagcugcuauccugaugcuggcgaaaucacgugugugugccgggacaacuggcauggcuccaaucgccccugggugucuuuuaaccagaaucuugaguaccagauuggguauaucugcagcggagucuucggcgauaacccuagacccaaugacgggacaggauccuguggcccgaugagcccuaacggggccuacggagugaagggcuuuucuuucaaguacggcaaugggguuuggauuggacggaccaaauccacaaacagccgcucuggcuuugaaaugaucugggaucccaauggguggaccggaaccgacuccagcuucuccgugaagcaagacauugucgcgaucacagauuggucuggcuauagcggguccuuugugcagcacccugagcugacgggccucgacugcaucagacccuguuucuggguugaacugauucggggacagcccaaagagucuaccaucuggacaagcggcuccagcauuucuuucugcggggugaacuccgauaccgucagcuggucuuggccugacggagccgagcuuccguuuacaaucgauaaguga

SEQ ID NO: 198442 - RNA, 1410 nt, Artificial Sequence
  derived and/or modified sequence opt5 from neuraminidase__InfluenzaA__ABI84962
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuuccaaggacagccggucuggguacgaaacauuuaaggugaucggaggcugguccaccccuaauagcaaaucucagguuaacagacaagugauugucgauaauaacaauugguccggcuauagcgggaucuucuccguggagggaaagucuugcauuaaccgcuguuuuuacgucgagcuuauccggggcagaccccaggaaacacgcgugugguggaccagcaauuccauuguuguguucugcgggacgucuggaacauauggcaccgggagcuggcccgacggcgcuaacaucaauuuuaugccuaucuga

SEQ ID NO: 198443 - RNA, 1410 nt, Artificial Sequence
  derived and/or modified sequence opt5 from neuraminidase__InfluenzaA__ABI85003
augaaccccaaucagaagaucauuaccaucggcguggucaacacaacgcugagcaccauugcccuccugaucgggguuggaaaucuuguguucaacacagugauucacgagaaaaucggcgaccaucaaaucgucacccacccuacaauuaugaccccggaagugcccaauugcuccgauacaaucauuaccuacaacaauacgguuaucaacaauauuaccacaaccaucauuacagaggcugaaagaccuuuuaagucuccccugccucucugucccuuccggggguuuuucccuuuucauaaagacaacgccauccgccugggagagaauaaggaugugaucgucaccagagaaccguaugugagcugcgacaacgauaauuguugguccuucgcgcuugcucagggcgcccugcucgggacgaaacacucuaacggaacaauuaaggaccggacccccuaccgcagccugaucagauuuccuauuggcacagcccccguucugggcaauuauaaggagaucugcauugcuugguccucuagcuccuguuucgaugggaaagaguggaugcaugugugcaugaccggaaacgacaacgaugccagcgcucagaucaucuacggcgggcggaugaccgacucuauuaaguccuggcgcaaagauauccucagaacacaggaaagcgagugucaaugcauugacggaacgugugucguggccgugaccgauggcccugcggccaauucugcugaccaccgggucuauuggauccgcgaagggagaauuaucaaguacgagaacguucccaaaacaaagauccagcaccuggaggaaugcuccuguuauguggacauugauguguacugcaucugccgggacaauuggaagggaagcaaccgcccguggaugagaauuaauaacgagaccauccuugaaacaggcuacgucuguucuaaauuucauuccgauaccccucggcccgccgacccuagcauuauguccugcgauucucccagcaaugugaacggcgggcccggaguuaagggcuucggguuuaaagcuggaaaugacguguggcugggccgcacggucuccacaagcgggagaucuggauucgagaucauuaaggugaccgaaggcuggaucaacuccccuaaucacguuaaaagcaucacccagacacucgugucuaacaaugauuggagcggcuauuccgggucuuuuauugucaaggccaaagacuguuuccagccgugcuucuacguggagcugauccggggaagacccaacaagaaugaugacgucagcuggaccuccaacagcauugugacauuuuguggccuugauaacgagccugggucuggaaauuggcccgacggcuccaacaucggguucaugccuaaguga

SEQ ID NO: 198444 - RNA, 1410 nt, Artificial Sequence; identical to SEQ ID NO: 198114
  derived and/or modified sequence opt5 from neuraminidase__InfluenzaA__ABI92294

SEQ ID NO: 198445 - RNA, 1413 nt, Artificial Sequence
  derived and/or modified sequence opt5 from neuraminidase__InfluenzaA__ABI92305
augaaccccaaucagaagaucauuaccaucggcagcauuugcauggccaucgggauuaucucccugauccuccaaauuggaaacaucauuucuaucugggugagccaccugauucagacaggcucccagaaucauacggggaucuguaaccagagaauuaucaccuacgaaaauucuacaugggucaaccaaaccuauguuaauaucaacaauacaaacgugguggcuggaaaagacaccacaagcgucacccuugccggcaauuccucucugugcccugugcgggggugggcgauuuacagcaaggauaacuccauccgcauuggaagcaaaggcgacguuuucgugaucagagaaccguuuauuucuuguucccaccucgagugccggacguucuuucugacccagggcgcccuucugaaugauaagcauagcaacgggacagucaaagaccgcucucccuauagagcucucauguccuguccuaucggagaagcccccagcccuuacaauucucgguucgaguccguggcuuggagcgccuccgcuugccacgauggcaugggguggcugaccaucggaauuucuggccccgacgauggggccguugcggugcugaaguauaacggaaucauuacagaaaccaucaagagcuggcgcaaacggauucucagaacgcaggaguccgagugugucugcaucaacggcagcuguuuuacaaucaugaccgacggcccuucuaaugggccggccuccuaccgcauuuucaagaucgaaaaaggaaagauuacaaaaagcaucgagcuggaugcucccaacucucauuaugaagagugcagcuguuacccugacaccggcaccgugaugugcgugugcagagauaauuggcacggguccaaccggcccugggucucuuuuaaucagaaccuugacuaccaaauuggauauaucuguagcggcguuuucggggauaauccucgccccaaggacggaaagggcuccugcggcccggugacaguggacggggccgauggagucaaaggcuuuagcuacagauaugggaacggaguguggauuggccggacgaagucuaauuccagccgcaaaggguucgagaugaucugggacccuaacggcuggaccgauacagacucuaauuuucugguuaagcaggauguggucgcuaugaccgacugguccggauacagcggcuccuucgugcagcaccccgaacucacagggcuggauuguaugagaccuugcuuuuggguugagcuuauccggggaagaccccgcgagaaaaccacgauuuggacaucuggcagcuccaucucuuucuguggggugaacagcgacaccgucaauugguccuggcccgauggagccgagcugccuuucaccauugacaaguga

SEQ ID NO: 198446 - RNA, 1413 nt, Artificial Sequence
  derived and/or modified sequence opt5 from neuraminidase__InfluenzaA__ABI92316
augaaccccaaucagaagaucauuaccaucggcagcauuuccaucgccauuggggugaucucucugauccuccaaauuggaaacaucauuagcaucugggcuucccacucuauucagacaggcagccagaaucauacggggaucugcaaccagagaauuaucaccuacgagaauagcacaugggucaaccaaaccuauguuaauaucaacaauacaaacgugguggccggaaaagacaagaccucuaugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggccugggguggcugaccaucggaauuagcggccccgacaacggggcggucgccgugcucaaguauaacggaaucauuacagaaaccaucaaauccuggaagaaacgcauucugagaacgcaggagagcgagugcguuugugugaauggcucuugcuuuacaaucaugaccgauggcccuuccaacggggcugccagcuaccggaucuucaagauugaaaaaggacgcgucacaaagucuaucgagcuugacgcuccgaauuaucauuacgaagaguguagcugcuaccccgauaccggcaccgugaugugugugugcagagacaacuggcacggguccaaucggccuugggucucuuuuaaccagaaucuggauuaucaaauuggauacaucugcagcggcguuuucggggacaacccccgcccuaaggauggagagggcuccuguaaucccgugacaguggacggcgccgacggggucaaaggauuuagcuauagauacggcaacgggguguggauuggacggacgaagucuaaucgccucagaaaaggcuucgaaaugaucugggauccgaacggguggaccgacacagauuccgacuuuagcaugaagcaggauauuguugcgaugaccgacuggucuggcuauuccggauccuucgugcagcacccugagcugacaggccuugauugcaugcggcccuguuuuugggucgaacuggugagagggcucccucgcgagaauaccacgaucuggacauccggaucuagcaucuccuucugcggcguuaacucugacaccgccaauuggagcuggcccgauggggcugaacugcccuucaccauugacaaauga

SEQ ID NO: 198447 - RNA, 1410 nt, Artificial Sequence; identical to SEQ ID NO: 198125
  derived and/or modified sequence opt5 from neuraminidase__InfluenzaA__ABI92327

SEQ ID NO: 198448 - RNA, 1410 nt, Artificial Sequence
  derived and/or modified sequence opt5 from neuraminidase__InfluenzaA__ABI92338
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucauguguguguuaccggcgaugacgagaacgcuacagccuccuucauuuacaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucgucaacauuagcacacuuuccgggucugcucaacacguugaggaaugcagcuguuauccuagauaccccggagugcggugcgugugucgcgacaauuggaagggcuccaacagaccuaucauugauaucaaugucaaggacuacagcauugugucuuccuauguuugcagcggccuggugggggacacaccccggaaaaacgauucuuucagcuccucucacugucucgacccgaauaacgaggaaggaggccauggggucaagggaugggccuuugaugacggcaaugauguguggauggggcgcaccaucagcgagaaacugagauccggauacgagaccuucaagguuaucgaaggcuggagcaaaccuaacucuaagcugcagauuaaucgccaggugaucgucgagcggggcaacagauccggguauagcggaaucuuuucuguggaaggcaaauccugcauuaaucgguguuucuacgucgagcucauuagagggcgcaaggaagagacggaggugugguggacaagcaacuccaucguuguguuuugcggaaccucuggcaccuaugggacaggcagcuggcccgacggagcugauauuaaucugaugccuaucuga

SEQ ID NO: 198449 - RNA, 1410 nt, Artificial Sequence
  derived and/or modified sequence opt5 from neuraminidase__InfluenzaA__ABI92349
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccaaguaccggaauuggagcaaaccccagugcaacaucaccggguucgcgccuuuuuccaaggacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugagcucggggugcccuuucaucugggaaccagacaggucuguaucgccuggagcuccagcucuugccacgacggcaaagccuggcuucauguguguguuacaggcgaugacgaaaacgcuaccgcuuccuucauuuacaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacacguugaagagugcagcuguuauccuagauaccccggagugcggugcgugugucgcgacaacuggaagggcuccaauagaccuaucgucgauauuaacgugaaagacuacagcaucguuucuuccuaugugugcagcggccuggucggggacacaccccggaagaaugauucuuucagcuccucucauugucucgacccgaacaaugaagagggaggccacggggugaaaggaugggcuuuugaugacggcaacgauguuuggauugggcgcaccaucagcgaaaagcugagauccggauacgagacguucaaagugaucgagggcuggagcaagccuaauucuaaacugcagacaaaccggcaggucauuguggaacgcggcaauagauccggguauagcggaaucuuuucugucgagggcaaguccugcauuaaccgguguuucuacguggaacucaucagagggcgcaaggaggaaaccgagguuugguggaccagcaauuccauuguggucuuuugcggaacaucuggcaccuaugggacaggcagcuggcccgacggagccgauaucaaccugaugccuauuuga

SEQ ID NO: 198450 - RNA, 1410 nt, Artificial Sequence; identical to SEQ ID NO: 197351
  derived and/or modified sequence opt5 from neuraminidase__InfluenzaA__ABI92360

SEQ ID NO: 198451 - RNA, 1410 nt, Artificial Sequence; identical to SEQ ID NO: 197351
  derived and/or modified sequence opt5 from neuraminidase__InfluenzaA__ABI92371

SEQ ID NO: 198452 - RNA, 1413 nt, Artificial Sequence; identical to SEQ ID NO: 197410
  derived and/or modified sequence opt5 from neuraminidase__InfluenzaA__ABI92382

SEQ ID NO: 198453 - RNA, 1410 nt, Artificial Sequence; identical to SEQ ID NO: 197738
  derived and/or modified sequence opt5 from neuraminidase__InfluenzaA__ABI92393

SEQ ID NO: 198454 - RNA, 1410 nt, Artificial Sequence; identical to SEQ ID NO: 197351
  derived and/or modified sequence opt5 from neuraminidase__InfluenzaA__ABI92404

SEQ ID NO: 198455 - RNA, 1410 nt, Artificial Sequence
  derived and/or modified sequence opt5 from neuraminidase__InfluenzaA__ABI92415
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugaucgaggggugguccaacccuaauagcaaacugcagauuaacagacaggucaucguggaucggggaaaucgcucuggcuauuccggcauuuucagcgucgaagggaaguccuguaucaacagaugcuuuuacguggagcugauucggggaagaaaggaagagaccgaaguucucuggaccucuaauagcaucguggucuucuguggcacauccgggaccuauggaacaggcucuuggcccgacggggcugauauuaacuucaugccuaucuga

SEQ ID NO: 198456 - RNA, 1410 nt, Artificial Sequence; identical to SEQ ID NO: 197738
  derived and/or modified sequence opt5 from neuraminidase__InfluenzaA__ABI92426

SEQ ID NO: 198457 - RNA, 1410 nt, Artificial Sequence; identical to SEQ ID NO: 197738
  derived and/or modified sequence opt5 from neuraminidase__InfluenzaA__ABI92437

SEQ ID NO: 198458 - RNA, 1410 nt, Artificial Sequence; identical to SEQ ID NO: 197738
  derived and/or modified sequence opt5 from neuraminidase__InfluenzaA__ABI92448

SEQ ID NO: 198459 - RNA, 1410 nt, Artificial Sequence; identical to SEQ ID NO: 197738
  derived and/or modified sequence opt5 from neuraminidase__InfluenzaA__ABI92459

SEQ ID NO: 198460 - RNA, 1410 nt, Artificial Sequence
  derived and/or modified sequence opt5 from neuraminidase__InfluenzaA__ABI92470
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccgagaaggcggauacaaaaauucuguuuaucgaagagggaaagaucguccacaccagcucccuuucuggcagcgcccaacacguugaagagugcuccuguuauccucgcuaccccggggugagaugcgugugucgggacaacuggaagggaagcaaucgcccuauugucgauaucaacgugaaagacuacucuauuguuuccagcuaugugugcucuggccuggucggcgacacacccagaaagaaugauagcuccucuagcucccauugucucgacccgaacaaugaagaagggggacacggcgugaaagggugggcuuucgaugacggaaacgauguuuggaugggccggaccaucagcgagaagcugcgcucuggguacgagacguuuaaagugauugagggaugguccaagccuaauagcaaacugcagaucaacagacaggucaucguggaccggggcaaucgcucuggcuauuccgggauuuucagcgucgaauccaagucuugcaucaacagauguuuuuacguggagcucauucggggaagaaagcaggaaacagagguucuguggaccagcaauuccaucguggucuucugcggcaccucugggacauauggaaccggcagcuggcccgauggggccgacauuaaccuuaugccuaucuga

SEQ ID NO: 198461 - RNA, 1410 nt, Artificial Sequence; identical to SEQ ID NO: 197754
  derived and/or modified sequence opt5 from neuraminidase__InfluenzaA__ABI92481

SEQ ID NO: 198462 - RNA, 1410 nt, Artificial Sequence; identical to SEQ ID NO: 197754
  derived and/or modified sequence opt5 from neuraminidase__InfluenzaA__ABI92492

SEQ ID NO: 198463 - RNA, 1410 nt, Artificial Sequence
  derived and/or modified sequence opt5 from neuraminidase__InfluenzaA__ABI92503
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggaggaguaccggaauuggagcaagccccagugcaacaucaccggguucgccccuuuuuccaaagacaauucuauucgccuuagcgcgggaggcgauaucugggucacaagagaacccuauguguccugugacccugauaagugcuaccaauucgcucuggggcagggaaccacacucaacaauggccauucuaacgacaccguucacgaucggacgccguaucgcacacugcugaugaaugagcucggggugcccuuucaucugggaaccaagcaggucuguaucgccuggagcuccagcucuugccacgacggcaaagccuggcuucauguguguguuacaggcgaugacgaaaacgcuaccgccuccuucauuuacaaugggagacugguggauagcaucggaucuugguccaagaaaauucuccggacccaggagagcgagugcgucuguaucaacggcacaugcacgguggugaugaccgacgggucugcuuccggaaaggccgauacaaaaauucuguuuaucgaagagggcaagaucguccacaccagcucccuuucugggagcgcgcaacacguugaagagugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaagagggaggccacggggugaaaggaugggccuucgaugacggcaacgauguuuggauggggcggaccaucagcgagaagcugcgcucuggauacgaaacguuuaaagugauugagggcugguccaagccuaauagcaaacugcagaucaacagacaggucaucguggaccggggcaaucgcucuggguauuccggaauuuucagcgucgaauccaagucuugcaucaacagauguuuuuacguggagcucauucggggcagaaagcaggaaacagagguucuguggaccagcaauuccaucguggucuucugcgggaccucuggaacauauggcaccgggagcuggcccgauggcgcugacauuaaccuuaugccuaucuga

SEQ ID NO: 198464 - RNA, 1410 nt, Artificial Sequence
  derived and/or modified sequence opt5 from neuraminidase__InfluenzaA__ABI92514
augaaccccaaucagaagaucauuaccaucggcagcgugucccugacaauugccacgaucugcuuccucguccaaauugcuauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggugacaagagagcccuauguuuccugugacccugauaagugcuaccaauucgcccuggggcagggaaccacacucaauaaccggcauucuaaugacaccgugcacgaucgcacgccguauagaacacugcugaugaacgaacucggcguccccuuucaucuggggaccaaacagguguguaucgccuggagcuccagcucuugccacgacggaaaggcuuggcuucauguuugugugacaggcgaugacgagaaugccaccgcuuccuucauuuacgauggccggcuggucgacagcaucgggucuugguccaaaaagauucuccgcacccaggaaagcgagugcguguguaucaacggaacaugcacgguggucaugaccgauggcucugccuccgggagagcggacacaaaaauucuguuuaucgaggaaggaaagaucguucacaccagcaaacuuuccggcucugcccaacacguggaggaaugcagcuguuauccucgguaccccggggugcgcugcgucuguagagauaauuggaagggauccaaccggccuauuguggacaucaacguuaaggacuacagcauugugucuuccuaugucugcagcggccuggugggcgauacaccccgcaaaaaugacucuagcuccucuagccauugucucgauccgaacaaugaggaagggggacacggcguuaaggggugggcuuucgacgauggagacgauguguggaugggcagaaccaucuccgagaaaagccggucuggguacgagacguuuaaggucauugaaggaugguccaaaccuaacagcaagcugcagaucaaucgccaggugaucgucgagagaggcaacaugucuggcuauuccgggauuuucagcguggaaggaaaguccugcaucaaucgguguuuuuacguugagcugauuagaggccgcaaacaggaaacagaggugugguggaccucuaacagcaucgucguguucugcgggaccuccggaacauauggcaccgggucuuggcccgacggcgccgauauuaaucucaugccuaucuga

SEQ ID NO: 198465 - RNA, 1410 nt, Artificial Sequence
  derived and/or modified sequence opt5 from neuraminidase__InfluenzaA__ABI92525
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacacccagaaagaaugauucuuucagcuccucucauugucucgacccgaacaaugaggaaggaggccacggggugaaaggaugggcuuuugaugacggcaacgauguuuggauggggcggaccauuagcgagaagcugcgcuccggauacgagacguucaaagugaucgaaggcuggagcaagccuaauucuaaacugcagaucaacagacaggucauuguggagcggggcaaucgcuccggguauagcggaaucuuuucugucgaaggcaaguccugcauuaacagauguuucuacguggagcucauccgggggagaaaggaagagacagagguuugguggaccagcaauuccauuguggucuuuugcggaaccucuggcacauaugggaccggcagcuggcccgacggagccgauaucaaccugaugccuauuuga

SEQ ID NO: 198466 - RNA, 1410 nt, Artificial Sequence
  derived and/or modified sequence opt5 from neuraminidase__InfluenzaA__ABI92536
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaaaauguccuaagcuggccgaguaccggaauuggagcaaaccccagugcaacauuaccggguucgcgccuuuuuccaaggacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaagccuggcuucauguguguguuacaggcgaugacgagaacgcuaccgcuuccuucaucuacaaugggcggcugguggauagcauuggaucuugguccaagaaaauccuccgcacccaggaaagcgagugcgucuguauuaacggcacaugcacgguggugaugaccgacgggucugccuccggaaaggcggauacaaaaauccuguuuauugaggaaggcaagaucguccacaucagcacccuuuccgggucugcccaacacguugaggaaugcagcuguuauccuagauaccccggagugcggugcgugugucgcgacaacuggaagggcuccaauagaccuauugucgauaucaacgugaaagacuacagcauuguuucuuccuaugugugcagcggccuggucggggacacaccccggaagaaugauucuuucagcuccucucauugucucgacccgaacaaugaggaaggaggccacggggugaaaggaugggcuuuugaugacggcaacgauguuuggauggggcgcaccaucagcgagaagcugagauccggauacgagacguucaaagugauugaaggcuggagcaagccuaauucuaaacugcagaucaaccggcaggucaucguggagcgcggcaauagauccggguauagcggaaucuuuucugucgaaggcaaguccugcauuaaccgguguuucuacguggagcucauuagagggcgcaaggaagagacagagguuugguggaccagcaauuccaucguggucuuuugcggaaccucuggcacauauggggccggcagcuggcccgacggagcugauauuaaccugaugccuaucuga

SEQ ID NO: 198467 - RNA, 1410 nt, Artificial Sequence
  derived and/or modified sequence opt5 from neuraminidase__InfluenzaA__ABI92547
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauguguccuaaacuggccgaguaccggaauuggagcaagccccagugcaacauuaccggguucgcgccuuuuuccaaagacaauucuauccgccuuagcgcuggaggcgauauuugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucaucuacaaugggcggcugguggauagcauuggaucuugguccaaaaagauccuccgcacccaggaaagcgagugcgucuguauuaacggcacaugcacgguggugaugaccgacgggucugccuccggaaaagcggauacaaagauccuguuuauugaggaaggcaaaaucguccacaucagcacccuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacguucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagacagagguuugguggaccagcaauuccaucguggucuuuugcggaaccucuggcacauauggggccggcagcuggcccgacggagcugauauuaaccugaugccuaucuga

SEQ ID NO: 198468 - RNA, 1410 nt, Artificial Sequence
  derived and/or modified sequence opt5 from neuraminidase__InfluenzaA__ABI92558
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagccgcccccagugcaacaucaccggguucgcgccuuuuuccaaggacaauucuauuagacuuagcgcuggaggcgauaucugggucacacgggagcccuauguguccugugacccugauaaaugcuaccaauucgcccuggggcagggaaccacacucaacaauggccauucuaacgacaccguucacgaucgcacgccguauagaacacugcugaugaaugaacucggggugcccuuucaucugggaacccggcaggucuguaucgccuggagcuccagcucuugccacgacggcaaggcuuggcuucauguguguguuacaggcgaugacgagaacgccaccgcuuccuucauuuacaaugggcgccugguggauagcaucggaucuugguccaagaaaauucucagaacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgguaccccggagugcgcugcguguguagagacaacuggaaaggcuccaaucggccuaucgucgauauuaacgugaaggacuacagcaucguuucuuccuaugugugcagcggccuggucggggacacaccccgcaagaaugauucuuucagcuccucucauugucucgacccgaacaaugaggaaggaggccacggggugaaaggaugggcuuuugaugacggcaacgauguuuggauggggagaaccauuagcgagaagcugcgguccggauacgagacguucaaagugaucgaaggcuggagcaagccuaauucuaaacugcagaucaaccgccaggucauuguggagagaggcaaucgguccggguauagcggaaucuuuucugucgaaggcaaguccugcauuaacagauguuucuacguggagcucauccgcgggcggaaagaagagacagagguuugguggaccagcaauuccauuguggucuuuugcggaaccucuggcacauaugggaccggcagcuggcccgacggagccgauaucaaccugaugccuauuuga

SEQ ID NO: 198469 - RNA, 1410 nt, Artificial Sequence
  derived and/or modified sequence opt5 from neuraminidase__InfluenzaA__ABI92569
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggaaacugguggauagcaucggaucuugguccaagaaaauucuccggacccaggaaagcgagugcgucuguaucaacggcacaugcgccguggugaugacggacgggucugcguccggaaaggccgauaccaaaauucuguuuaucgaggaaggcaagaucguccacauuagcacacuuuccgggucugcucaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacccccagaaagaaugauucuuucagcuccucucauugucucgacccgaacaaugaggaaggaggccacggggugaaaggaugggccuuugaugacggcaacgauguuuggauggggcggacaauuagcgagaagcugcgcuccggauacgagaccuucaaagugaucgaaggcuggagcaagccuaauucuaaacugcagacgaacagacaggucaucguggagcggggcaaucgcuccggguauagcggaaucuuuucugucgaaggcaaguccugcauuaacagauguuucuacguggagcucauucgggggagaaaggaagagacagagguuugguggaccagcaauuccaucguggucuuuugcggaaccucuggcacauaugggaccggcagcuggcccgacggagcugauauuaaccugaugccuaucuga

SEQ ID NO: 198470 - RNA, 1410 nt, Artificial Sequence
  derived and/or modified sequence opt5 from neuraminidase__InfluenzaA__ABI92580
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaacaaggugaugcugugcgaacccacaaucauugagagaaauaucaccgaaauuguguaucucacaaacaccacgaucgagaaagaaauuuguccuaagcuggccgaguaccggaauuggagcaaaccccagugcaacaucaccggguucgcgccuuuuuccaaggacaauucuauucgccuuagcgcuggaggcgauaucugggucacaagagagcccuauguguccugugacccugauaagugcuaccaguucgcccuggggcaaggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaagccuggcuucauguguguguuacaggcgaugacgagaacgcuaccgcuuccuucauuuacaaugggcggcugguggauagcaucggaucuugguccaagaaaauucuccgcacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccagcacguugaggaaugcagcuguuauccuagauaccccggagugcggugcgugugucgcgacaacuggaagggcuccaauagaccuaucgucgauauuaacgugaaagacuacagcaucguuucuuccuaugugugcagcggccuggucggggacacaccccggaagaaugauucuuucagcuccucucauugucucgacccgaacaaugaggaaggaggccacggggugaaaggaugggcuuuugaugacggcaacgauguuuggauggggcgcaccauuagcgagaagcugagauccggauacgagacguucaaagugaucgaaggcuggagcaagccuaauucuaaacugcaaaucaaccggcaggucauuguggagcgcggcaauagauccggguauagcggaaucuuuucugucgaaggcaaggggugcauuaaccgguguuucuacguggagcucaucagaggacgcaaggaagagacagagguuugguggaccuccaauagcauuguggucuuuugcggcaccuccgggacauauggcaccggaucuuggcccgacggcgccgauaucaaccugaugccuauuuga

SEQ ID NO: 198471 - RNA, 1410 nt, Artificial Sequence
  derived and/or modified sequence opt5 from neuraminidase__InfluenzaA__ABI92591
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugagaacccggcaggucuguaucgccuggagcuccagcucuugccacgacggaaaggcuuggcuucauguguguguuacaggcgaugacgagaacgccaccgcuuccuucauuuacaauggccgccugguggauagcaucgggucuugguccaaaaagauucucagaacccaggaaagcgagugcgucuguaucaacggaacaugcacgguggugaugaccgacggcucugccuccgggaaagcggauacaaagauucuguuuaucgaggaaggaaaaaucguccacauuagcacccuuuccggcucugcccaacacguugaggaaugcagcuguuauccucgguaccccggggugcgcugcguguguagagacaacuggaagggauccaaucggccuaucgucgauauuaacgugaaggacuacagcaucguuucuuccuaugugugcagcggccuggucggcgacacaccccgcaaaaaugauucucucagcuccucucauugucuggacccgaacaaugaggaagggggacacggcgugaaggggugggcuuucgaugacggaaacgauguuuggaugggcagaaccauuagcgagaaacugcgguccggguacgagacguuuaaggugaucgaaggauggagcaaaccuaauucuaagcuccagaucaaccgccaggucauuguggagagaggcaaucgguccggcuauagcgggaucuucucugucgaaggaaaaggcugcauuaacagauguuuuuacguggagcugauccgcgggcggaaggaagagacagagguuugguggaccuccaauagcauuguggucuucugcggaaccuccggcacauaugggaccggcucuuggcccgacggagccgauaucaaccuuaugccuauuuga

SEQ ID NO: 198472 - RNA, 1410 nt, Artificial Sequence
  derived and/or modified sequence opt5 from neuraminidase__InfluenzaA__ABI92602
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuucccugauuuacaaugggcggcucguggauagcaucggaucuugguccaaaaagauucugcgcacccaggaaagcgagugcgucuguaucaacggcacaugcacgguggugaugaccgacgggucugccuccggaaaagcggauacaaagauucuuuucaucgaggaaggcaaaaucguccacauuagcacccuguccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccucgucggggacacaccccggaaaaaugauucuuuuagcuccucucauugucuggacccgaacaaugaggaaggaggccacggggugaagggaugggcuuucgaugacggcaacgauguuuggauggggcgcaccauuagcgagaaacugagauccggauacgagacguuuaaggugaucgaaggcuggagcaaaccuaauucuaagcuccaggucaaccgccaggugaucgucgagcggggcaauagauccggguauagcggaauuuucucuguggaaggcaaauccugcaucaaccgguguuuuuacguugagcugauuagagggcgcaaggaagagacagaggugugguggaccagcaauuccaucgucguguucugcggaaccucuggcacauaugggaccggcagcuggcccgacggagccgauauuaaccuuaugccuaucuga

SEQ ID NO: 198473 - RNA, 1410 nt, Artificial Sequence
  derived and/or modified sequence opt5 from neuraminidase__InfluenzaA__ABI92613
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgauaacgagaaugccaccgcuuccuucauuuacaacgggaaacugguggacagcaucggaucuugguccaagaaaauucuccggacccaggaaagcgagugcgucuguaucaacggcacaugcgccguggugaugacggaugggucugcguccggaaaggccgacaccaaaauucuguuuaucgaggaaggcaagaucguccacauuagcacacuuuccgggucugcucaacacguugaggaaugcagcuguuauccucgcuaccccggagugagaugcgugugucgggauaauuggaagggcuccaaccgcccuaucgucgacauuaaugugaaagauuacagcaucguuucuuccuaugugugcagcggccuggucggggacacccccagaaagaacgacucuuucagcuccucucauugucucgauccgaauaacgaggaaggaggccacggggugaaaggaugggccuuugacgauggcaaugacguuuggauggggcggacaauuagcgagaagcugcgcuccggauacgagaccuucaaagugaucgaaggcuggagcaagccuaacucuaaacugcagacgaauagacaggucaucguggagcggggcaaccgcuccggguauagcggaaucuuuucugucgaaggcaaguccugcauuaauagauguuucuacguggagcucauucgggggagaaaggaagagacagagguuugguggaccagcaacuccaucguggucuuuugcggaaccucuggcacauaugggaccggcagcuggcccgauggagcugacauuaaucugaugccuaucuga

SEQ ID NO: 198474 - RNA, 1410 nt, Artificial Sequence
  derived and/or modified sequence opt5 from neuraminidase__InfluenzaA__ABI92624
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucaucagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguauugccuggagcuccagcucuugccacgacggcaaggcuuggcuucauguguguguuaccggcgaugacgagaacgccacagcuuccuucaucuacaaugggcggcugguggauagcauuggaucuugguccaaaaagauccuccgcacccaggaaagcgagugcgucuguauuaacgggaccugcacaguggugaugacggacggcucugccuccggaaaagcggauaccaagauccuguuuaucgaggaaggcaaaauuguccacaucagcacacuuuccgggucugcccaacacguugaggaaugcagcuguuauccuagauaccccggagugcggugcgugugucgcgacaacuggaagggcuccaauagaccuauugucgauaucaacgugaaggaccauagcauuguuucuuccuacgugugcagcggccuggucggggacacaccccggaaaaaugauucuuucagcuccucucacugucucgacccgaacaaugaggaaggaggccauggggugaagggaugggcuuuugaugacggcaacgauguuuggauggggcgcaccaucagcgagaaacugagauccggauaugagaccuucaaggugaucgaaggcuggagcaaaccuaauucuaagcugcagauuaaccggcaggucaucguggagcgcggcaauagauccggguacagcggaaucuuuucugucgaaggcaaauccugcauuaaccgguguuucuauguggagcucauuagagggcgcaaggaagagacggagguuugguggacaagcaauuccaucguggucuuuugcggaaccucuggcaccuacgggacaggcagcuggcccgacggagccgauauuaaccugaugccuaucuga

SEQ ID NO: 198475 - RNA, 1410 nt, Artificial Sequence
  derived and/or modified sequence opt5 from neuraminidase__InfluenzaA__ABI92635
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaaccuuaccggguucgcgcccuuuagcaaagacaauuccauccgccugucugcuggaggcgauauuugggucacaagagagccuuaugugagcugugacccggauaagugcuaccaauucgcccucgggcagggaaccacacugaacaauggccauuccaacgacaccguucacgaucggacgcccuaucgcacacugcucaugaaugaacugggggugccuuuucaucuuggaaccagacaggucuguaucgccuggucuagcuccagcugccacgacggcaaggcuuggcugcauguguguguuacaggcgaugacgagaacgccaccgcuucuuucaucuacaaugggcggcucguggauuccauuggaagcuggucuaaaaagauccugcgcacccaggaauccgagugcgucuguauuaacggcacaugcacgguggugaugaccgacgggagcgccucuggaaaagcggauacaaagaucauuuuuaucgaggaaggcaaaaucguccacaccuccacacuuagcggguccgcccaacacguugaggaaugcucuuguuaucccagauacccuggagugcggugcgugugucgcgacaacuggaagggcagcaauagacccauugucgauaucaacgugaaggacuacuccauuguuagcucuuaugugugcuccggccuggucggggacaccccgcggaaaaaugauagcuucucuagcucccauugucucgacccuaacaaugaggaaggaggccacggggugaagggaugggcuuuugaugacggcaacgauguuuggauggggcgcacgaucucugagaaacugagaagcggauacgagacauucaaggugauugaaggcugguccaaacccaauagcaagcugcagaccaaccggcaggucaucguggagcgcggcaauagaucuggguauuccggaaucuuuagcgucgaaggcaaaucuugcauuaaccgguguuucuacguggagcucaucagagggcgcaaggaagagaccgagguuugguggacauccaauagcauuguggucuuuugcggaaccuccggcacauaugggacgggcucuuggccugacggagccgauaucaaccugaugcccauuuga

SEQ ID NO: 198476 - RNA, 1410 nt, Artificial Sequence; identical to SEQ ID NO: 197169
  derived and/or modified sequence opt5 from neuraminidase__InfluenzaA__ABI92646

SEQ ID NO: 198477 - RNA, 1410 nt, Artificial Sequence; identical to SEQ ID NO: 197169
  derived and/or modified sequence opt5 from neuraminidase__InfluenzaA__ABI92657

SEQ ID NO: 198478 - RNA, 1410 nt, Artificial Sequence
  derived and/or modified sequence opt5 from neuraminidase__InfluenzaA__ABI92668
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugggccugacaagugcuaucaauucgcccugggacagggcaccacacucaacaaugggcacucuaacgauaccguucaugaccggacgccguaccgcacacugcugaugaaugaacucggagugcccuuucaccugggcaccagacaggucuguaucgccuggagcuccagcucuugccaugauggcaaggcuuggcuucacguguguguuacaggggacgauaaaaacgccaccgcuuccuucauuuauaauggacggcugguggacagcaucggcucuugguccaagaaaauucuccgcacccaggagagcgaaugcgucuguaucaacgggacaugcacgguggugaugaccgauggaucugccuccggcaaggcggacacaaaaauucuguuuaucgaggaggggaagaucguccacauuagcacccuuuccggaucugcccaacauguugaagagugcagcuguuacccuagauaucccggcgugcggugcgugugucgcgauaacuggaagggcuccaauagaccuaucgucgacauuaacgugaaagauuacagcaucguuucuuccuacgugugcagcgggcuggucggagacacaccccggaagaaugacucuuucagcuccucucacugucucgauccgaacaaugaagagggcgggcauggagugaaaggcugggcuuuugacgaugggaacgacguuuggaugggacgcaccauuagcgaaaagcugagauccggcuaugagacguucaaagugaucgagggcuggagcaagccuaauucuaaacugcagaucaaccggcaggucauuguggaacgcgggaauagauccggauacagcggcaucuuuucugucgaggggaaguccugcauuaaccgguguuucuauguggaacucaucagaggacgcaaggaggaaacagagguuugguggaccagcaauuccauuguggucuuuugcggcaccucugggacauacggcaccggaagcuggcccgauggcgccgacaucaaccugaugccuauuuga

SEQ ID NO: 198479 - RNA, 1410 nt, Artificial Sequence; identical to SEQ ID NO: 197615
  derived and/or modified sequence opt5 from neuraminidase__InfluenzaA__ABI92679

SEQ ID NO: 198480 - RNA, 1410 nt, Artificial Sequence; identical to SEQ ID NO: 197169
  derived and/or modified sequence opt5 from neuraminidase__InfluenzaA__ABI92701

SEQ ID NO: 198481 - RNA, 1410 nt, Artificial Sequence
  derived and/or modified sequence opt5 from neuraminidase__InfluenzaA__ABI92712
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggccaugcugugcgaacccacaaccacagagagaaauaccacggaaaucguguaccucaccaacacaaccauugagaaggaaaucuguccuaaacugguggaguaucggaauuggagcaagccccagugcaacauuacaggguucgcgccuuuuuccaaagacaauucuauccgccuuagcgcuggaggcgauauuugggucaccagagagcccuacguguccugugacccugauaagugcuaucaauucgcccuggggcagggaacgacacucaacaauggccacucuaacgacaccguucaugaucggacaccguaccgcacccugcugaugaaugaacucggggugcccuuucaccugggaaccagacaggucuguaucgccuggagcuccagcucuugccaugacggcaaggcuuggcuucacguguguguuacaggcgaugacaaaaacgccacggcuuccuucauuuauaaugggcggcugguggauagcaucggaucuugguccaagaaaauccuccgcacccaggagagcgaaugcgucuguauuaacggcacaugcaccguggugaugacagacgggucugccuccggaaaggcggauaccaaaauccuguuuauugaggagggcaagaucguccacauuagcacgcuuuccgggucugcccaacauguugaagagugcagcuguuacccuagauaucccggagugcggugcgugugucgcgacaacuggaagggcuccaauagaccuaucgucgauaucaacgugaaagacuacagcauuguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccaucagcgaaaagcugagauccggauaugagaccuucaaagugauugagggcuggagcaagccuaauucuaaacugcagaucaaccggcaggucauuguggaacgcggcaauagauccggguacagcggaaucuuuucugucgagggcaaguccugcaucaaccgguguuucuauguggaacucauuagagggcgcaaggaggaaacagagguuugguggaccagcaauuccaucguggucuuuugcggaacaucuggcacguacgggaccggcagcuggcccgacggagccgauauuaaccugaugccuaucuga

SEQ ID NO: 198482 - RNA, 1410 nt, Artificial Sequence
  derived and/or modified sequence opt5 from neuraminidase__InfluenzaA__ABI92723
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccaaacagguguguaucgccuggagcuccagcucuugccaugacggcaaagccuggcuucacguuugugugacaggcgaugacaagaacgcuaccgccuccuucauuuauaaugggagacuggucgauagcaucggaucuugguccaaaaagauucuccggacccaggagagcgaaugcguguguaucaacggcacaugcacgguggucaugaccgacgggucugcuuccggaaaagccgauacaaagauucuguuuaucgaggagggcaagaucguucacauuagcacccuuuccgggucugcgcaacauguggaagagugcagcuguuacccucgcuaucccggagugagaugcgucugucgggacaacuggaaaggcuccaaucgcccuaucguggauauuaacguuaaggacuacagcaucgugucuuccuacgucugcagcggccuggugggggacacacccagaaagaaugauucuuucagcuccucucacugucucgacccgaacaaugaagagggaggccaugggguuaagggaugggccuuugaugacggcaacgauguguggauggggcggaccauuagcgaaaaacugcgcuccggauaugagacguucaaggucaucgagggcuggagcaaaccuaauucuaagcugcagaucaacagacaggugauugucgaacggggcaaucgcuccggguacagcggaaucuuuucuguggagggcaaguccugcauuaacagauguuucuauguugaacucauccgggggagaaaagaggaaacagaggugugguggaccagcaauuccauugucguguuuugcggaaccucuggcacauacgggaccggcagcuggcccgacggagcugauaucaaccugaugccuauuuga

SEQ ID NO: 198483 - RNA, 1410 nt, Artificial Sequence; identical to SEQ ID NO: 197169
  derived and/or modified sequence opt5 from neuraminidase__InfluenzaA__ABI92734

SEQ ID NO: 198484 - RNA, 1410 nt, Artificial Sequence; identical to SEQ ID NO: 197615
  derived and/or modified sequence opt5 from neuraminidase__InfluenzaA__ABI92745

SEQ ID NO: 198485 - RNA, 1410 nt, Artificial Sequence
  derived and/or modified sequence opt5 from neuraminidase__InfluenzaA__ABI92756
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugauccugugcgaacccacaauuaucgagagaaauauuaccgaaaucguguaccucacaaacaccacgauugagaaggaaaucuguccuaaacuggccgaguaucggaauuggagcaagccccagugcaacauuaccggguucgcgccuuuuuccaaagacaauucuauccgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguauugccuggagcuccagcucuugccaugacggcaaggcuuggcuucacguguguguuacaggcgaugacaaaaacgccaccgcuuccuucaucuauaaugggcggcugguggauagcauuggaucuugguccaagaaaauccuccgcacccaggagagcgaaugcgucuguauuaacggcacaugcacgguggugaugaccgacgggucugccuccggaaaggcggauacaaaaauccuguuuaucgaggagggcaagauuguccacaucagcacccuuuccgggucugcccaacauguugaagagugcagcuguuacccuagauaucccggagugcggugcgugugucgcgacaacuggaagggcuccaauagaccuauugucgauaucaacgugaaagacuacagcauuguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccaucagcgaaaagcugagauccggauaugagacguucaaagugaucgagggcuggagcaagccuaauucuaaacugcagauuaaccggcaggucaucguggaacgcggcaauagauccggguacagcggaaucuuuucugucgagggcaaguccugcauuaaccgguguuucuauguggaacucauuagagggcgcaaggaggaaacagagguuugguggaccagcaauuccaucguggucuuuugcggaaccucuggcacauacgggaccggcagcuggcccgacggagccgauauuaaccugaugccuaucuga

SEQ ID NO: 198486 - RNA, 1410 nt, Artificial Sequence
  derived and/or modified sequence opt5 from neuraminidase__InfluenzaA__ABI92767
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacguucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggagaaaacagaaguuugguggaccagcaauuccauuguggucuuuugcggaaccucuggcacauacgggaccggcagcuggcccgacggagccgauaucaaccugaugccuauuuga

SEQ ID NO: 198487 - RNA, 1410 nt, Artificial Sequence; identical to SEQ ID NO: 197169
  derived and/or modified sequence opt5 from neuraminidase__InfluenzaA__ABI92778

SEQ ID NO: 198488 - RNA, 1410 nt, Artificial Sequence; identical to SEQ ID NO: 197351
  derived and/or modified sequence opt5 from neuraminidase__InfluenzaA__ABI92789

SEQ ID NO: 198489 - RNA, 1410 nt, Artificial Sequence; identical to SEQ ID NO: 197351
  derived and/or modified sequence opt5 from neuraminidase__InfluenzaA__ABI92800

SEQ ID NO: 198490 - RNA, 1410 nt, Artificial Sequence; identical to SEQ ID NO: 197351
  derived and/or modified sequence opt5 from neuraminidase__InfluenzaA__ABI92811

SEQ ID NO: 198491 - RNA, 1410 nt, Artificial Sequence; identical to SEQ ID NO: 197351
  derived and/or modified sequence opt5 from neuraminidase__InfluenzaA__ABI92822

SEQ ID NO: 198492 - RNA, 1410 nt, Artificial Sequence; identical to SEQ ID NO: 197351
  derived and/or modified sequence opt5 from neuraminidase__InfluenzaA__ABI92844

SEQ ID NO: 198493 - RNA, 1410 nt, Artificial Sequence; identical to SEQ ID NO: 197351
  derived and/or modified sequence opt5 from neuraminidase__InfluenzaA__ABI92855

SEQ ID NO: 198494 - RNA, 1410 nt, Artificial Sequence
  derived and/or modified sequence opt5 from neuraminidase__InfluenzaA__ABI92866
augaaccccaaucagaagaucauuaccaucggcagcgccucccugacaauugcuacgaucugcuuccucauucaaaucgccauccugguuaccacagucacccuucacuuuaaacagcaugaguguaacucucugccuaauaaccagguuaugcucugcgaaccgacaauuaucgagagaaauauuaccgaaaucguguaccugacaaacaccacgauugagaaggaaaucugucccaaacuugcggaguaucggaauuggagcaagccucagugcaacauuaccggguucgcucccuuuuccaaagacaauucuauccgccugagcgccggaggcgauaucugggugacaagagagccuuacgucuccugugaccccgauaagugcuaucaauucgcccucgggcagggaaccacacugaacaauggccacucuaacgacaccgugcaugaucggacgccuuaccgcacacugcucaugaaugaacuggggguuccguuucaccuuggaaccagacagguguguauugcuuggagcuccagcucuugccaugacggcaaggccuggcugcacgucugugugacaggcgaugacaaaaacgcuaccgccuccuucaucuauaaugggcggcucguugauagcauuucuuccuggagcaagaaaauccugcgcacccaggagucugaaugcguguguauuaacggaacaugcacggucgugaugaccgacggcuccgcgagcgggaaggccgauacaaaaauccuuuuuaucgaggagggaaagauuauccacauuuccacccugucuggcagcgcucaacauguggaagagugcuccuguuaccccagauauccugggguccggugcguuugucgcgacaacuggaagggaagcaauagacccaucguggauauuaacgugaaagacuacucuaucgucuccagcuacgugugcucuggccucguuggcgacacaccucggaagaaugauagcuucuccucuagccacugucuggaccccaacaaugaagaagggggacauggcgugaaagggugggccuuugaugacggaaacgaugucuggaugggccgcaccaucuccgagaagcugagaagcggguaugagacguucaaagugauugagggauggucuaauccgaacuccaagcuccagaucaaucggcagguuauuguggaacgcggcaacagaagcggcuacucugggaucuuuuccgucgagggaaaaagcugcauuaaucgguguuucuauguggaacugaucagaggccgcaaggaggaaacagaggucugguggaccuccaacucuauugugguguuuugcgggaccagcggaacauacggcaccggguccuggccugacggcgcugauaucaaucuuaugcccaucuga

SEQ ID NO: 198495 - RNA, 1410 nt, Artificial Sequence; identical to SEQ ID NO: 197351
  derived and/or modified sequence opt5 from neuraminidase__InfluenzaA__ABI92877

SEQ ID NO: 198496 - RNA, 1410 nt, Artificial Sequence; identical to SEQ ID NO: 197351
  derived and/or modified sequence opt5 from neuraminidase__InfluenzaA__ABI92888

SEQ ID NO: 198497 - RNA, 1410 nt, Artificial Sequence; identical to SEQ ID NO: 197351
  derived and/or modified sequence opt5 from neuraminidase__InfluenzaA__ABI92899

SEQ ID NO: 198498 - RNA, 1410 nt, Artificial Sequence; identical to SEQ ID NO: 197351
  derived and/or modified sequence opt5 from neuraminidase__InfluenzaA__ABI92910

SEQ ID NO: 198499 - RNA, 1410 nt, Artificial Sequence; identical to SEQ ID NO: 197351
  derived and/or modified sequence opt5 from neuraminidase__InfluenzaA__ABI92921

SEQ ID NO: 198500 - RNA, 1410 nt, Artificial Sequence; identical to SEQ ID NO: 197351
  derived and/or modified sequence opt5 from neuraminidase__InfluenzaA__ABI92932

SEQ ID NO: 198501 - RNA, 1410 nt, Artificial Sequence; identical to SEQ ID NO: 197738
  derived and/or modified sequence opt5 from neuraminidase__InfluenzaA__ABI92943

SEQ ID NO: 198502 - RNA, 1410 nt, Artificial Sequence; identical to SEQ ID NO: 197738
  derived and/or modified sequence opt5 from neuraminidase__InfluenzaA__ABI92954

SEQ ID NO: 198503 - RNA, 1410 nt, Artificial Sequence
  derived and/or modified sequence opt5 from neuraminidase__InfluenzaA__ABI92965
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuugucggcgauacccccagaaagaacgaccggagcuccucuagccauugccuggauccgaauaacgaagagggcgggcacggagugaagggcugggccuucgacgaugggaaugacguuuggaugggacgcacgaucuccgaaaaacucagaagcggcuacgagacauuuaaggugaucgagggguggucuaacccuaauuccaaacugcagauuaaccggcaggucaucguggaucgcggaaauagaagcggcuauucuggcauuuucuccgucgaagggaaaagcuguaucaaccggugcuuuuacguggagcugauuagaggacgcaaggaagagaccgaaguucucuggaccuccaauucuaucguggucuucuguggcacaagcgggaccuauggaacaggcuccuggcccgacggggcugauauuaaccugaugccuaucuga

SEQ ID NO: 198504 - RNA, 1410 nt, Artificial Sequence; identical to SEQ ID NO: 197738
  derived and/or modified sequence opt5 from neuraminidase__InfluenzaA__ABI92976

SEQ ID NO: 198505 - RNA, 1410 nt, Artificial Sequence; identical to SEQ ID NO: 197738
  derived and/or modified sequence opt5 from neuraminidase__InfluenzaA__ABI92987

SEQ ID NO: 198506 - RNA, 1410 nt, Artificial Sequence; identical to SEQ ID NO: 197738
  derived and/or modified sequence opt5 from neuraminidase__InfluenzaA__ABI92998

SEQ ID NO: 198507 - RNA, 1410 nt, Artificial Sequence; identical to SEQ ID NO: 197942
  derived and/or modified sequence opt5 from neuraminidase__InfluenzaA__ABI93009

SEQ ID NO: 198508 - RNA, 1410 nt, Artificial Sequence; identical to SEQ ID NO: 197738
  derived and/or modified sequence opt5 from neuraminidase__InfluenzaA__ABI93020

SEQ ID NO: 198509 - RNA, 1413 nt, Artificial Sequence; identical to SEQ ID NO: 198380
  derived and/or modified sequence opt5 from neuraminidase__InfluenzaA__ABI93031

SEQ ID NO: 198510 - RNA, 1410 nt, Artificial Sequence; identical to SEQ ID NO: 198135
  derived and/or modified sequence opt5 from neuraminidase__InfluenzaA__ABI93042

SEQ ID NO: 198511 - RNA, 1410 nt, Artificial Sequence; identical to SEQ ID NO: 197308
  derived and/or modified sequence opt5 from neuraminidase__InfluenzaA__ABI93053

SEQ ID NO: 198512 - RNA, 1410 nt, Artificial Sequence
  derived and/or modified sequence opt5 from neuraminidase__InfluenzaA__ABI93064
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacaccagcaaacuuuccggcucugcccaacauguugaggaaugcagcuguuauccucgguaccccggggugcgcugcguguguagagacaauuggaagggauccaaccggccuauugucgauaucaacgugaaggacuacagcauuguuucuuccuaugugugcagcggccuggucggcgacacaccccgcaaaaaugauucuagcuccucuagccacugucucgacccgaacaaugaggaagggggacauggcgugaaggggugggcuuucgaugacggaaacgauguuuggaugggcagaaccaucuccgagaaaagccggucuggguacgagacguuuaaggugauugaaggaugguccaaaccuaauagcaagcugcagaucaaccgccaggucaucguggagagaggcaaucggucuggcuauuccgggauuuucagcgucgaaggaaaguccugcaucaacagauguuuuuacguggagcugauucgcggccggaaacaggaaacagagguuugguggaccucuaauagcaucguggucuucugcgggaccuccggaacauauggcaccgggucuuggcccgacggcgccgauauuaaccucaugccuaucuga

SEQ ID NO: 198513 - RNA, 1410 nt, Artificial Sequence; identical to SEQ ID NO: 197754
  derived and/or modified sequence opt5 from neuraminidase__InfluenzaA__ABI93075

SEQ ID NO: 198514 - RNA, 1410 nt, Artificial Sequence; identical to SEQ ID NO: 197754
  derived and/or modified sequence opt5 from neuraminidase__InfluenzaA__ABI93086

SEQ ID NO: 198515 - RNA, 1410 nt, Artificial Sequence; identical to SEQ ID NO: 197754
  derived and/or modified sequence opt5 from neuraminidase__InfluenzaA__ABI93097

SEQ ID NO: 198516 - RNA, 1410 nt, Artificial Sequence
  derived and/or modified sequence opt5 from neuraminidase__InfluenzaA__ABI93108
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaugacuacucuauuguuuccagcuaugugugcucuggccuggucggggacacaccccggaaaaacgauagcuccucuagcucccauugucucgacccgaauaacgaggaaggaggccacggggugaagggaugggcuuucgaugacggcaaugauguuuggauggggagaaccaucagcgagaaacugcgcucuggauacgagacguuuaaggugauugaaggcugguccaaaccuaacagcaagcugcagaucaauagacaggucaucguggaccggggcaaccgcucuggguauuccggaauuuucagcgucgaguccaaaucuugcaucaauagauguuuuuacguggaacucauucggggcagaaagcaggagacagaaguucuguggaccagcaacuccaucguggucuucugcgggaccucuggaacauauggcaccgggagcuggcccgauggcgccgacauuaaucuuaugccuaucuga

SEQ ID NO: 198517 - RNA, 1410 nt, Artificial Sequence
  derived and/or modified sequence opt5 from neuraminidase__InfluenzaA__ABI93119
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauaacagcuccucuagccauugucucgacccgaauaacgaggaaggaggccacggggugaaaggaugggcuuucgaugacggcaaugauguuuggauggggcggaccaucuccgagaagcugcgcagcggauacgagacguuuaaagugauugaaggcuggucuaagccuaacuccaaacugcagaucaauagacaggucaucguggaccggagcaaccgcucuggcuauuccgggauuuucagcgucgaguccaagucuugcaucaauagauguuuuuacguggaacucauucggggaagaaagcaggagacagaaguucuguggaccagcaacuccaucguggucuucugcggcaccucugggacauauggaaccggcagcuggcccgauggggccgacauuaaucuuaugccuaucuga

SEQ ID NO: 198518 - RNA, 1416 nt, Artificial Sequence
  derived and/or modified sequence opt5 from neuraminidase__InfluenzaA__ABI94584
augaaccccaaucagaagcuguucgcccucagcggcguggcuaucgcccuguccguccuuaaccugcucauugggaucucuaauguuggacugaacgugagccuucaccugaaagagaagggcccuaaacaagaagagaaucugaccugcacaacgauuaaccagaauaacaccacaguggucgaaaauaccuacgugaacaauacaaccaucauuacaaaggggaccgaccucaaaacgccguccuaucugcuccugaacaagucucuuuguaauguugagggauggguggucaucgcgaaggauaacgcugugagauuuggcgaaagcgagcagaucauuguuacccgggagcccuacguguccugcgacccuacaggguguaaaauguaugcccugcaucagggaaccacaauccgcaauaagcacucuaacggcaccauucaugauagaacggccuuccggggccucaucagcacaccccuggggaccccucccacagucuccaacagcgacuuuaugugcgugggauggucuuccaccaccugucacgauggcauugcucgcaugacaaucugcauucaagggaauaacgacaaugccacggcuaccguguacuauaacagacggcuuacaaccacaaucaaaaccugggcccgcaauauccugagaacgcaggaaagcgagugugucugccauaacggaacaugugcgguugugaugaccgauggcucugccuccagccaggcuuacaccaaggugauguauuuccacaaagggcucgucgugaaggaagaggagcugcggggaucugcccgccacauugaagagugcuccuguuacggccauaaucagaagguuacaugcgugugcagagacaacuggcaaggcgcuaaucggccuaucauugaaaucgauaugagcacccuggagcacacaucccgcuacgucuguacggggauucucaccgacacaucuagaccgggagauaaaagcuccggcgacugcagcaaccccaucaccgggucuccuggagugcccggcguuaagggguuuggauuccugaauggcgauaacacauggcuuggccggaccaucuccccucgcagcagaucuggguuugaaaugcugaaaauucccaaugccggaacggacccgaacagccggaucgcggagagacaggagauuguggacaauaacaacugguccggcuauucugggagcuucaucgauuacuggaaugacaacuccgaauguuauaauccuugcuuuuacgucgagcucauucgcggacggcccgaagaggccaaguauguguggugggcuagcaacucucugaucgcccuuuguggcuccccuuuccccgucgggagcggcucuuuucccgauggagcucagauccaguacuucuccuga

SEQ ID NO: 198519 - RNA, 1413 nt, Artificial Sequence; identical to SEQ ID NO: 197852
  derived and/or modified sequence opt5 from neuraminidase__InfluenzaA__ABI95220

SEQ ID NO: 198520 - RNA, 1410 nt, Artificial Sequence
  derived and/or modified sequence opt5 from neuraminidase__InfluenzaA__ABI95242
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacggccggacgccguaucgcacacuccugaugaacgaacugggggugcccuuucaucucggaaccaagcaggucugcauugccugguccucuagcuccugucacgacggcaaagccuggcugcaugugugcguuacaggcgaugacaagaaugcuaccgccagcuucaucuacaacgggagacuuguggauucuauugucuccuggagcaaagagauccugcggacccaggaaucugagugugugugcauuaauggaacauguacgguggucaugaccgacggcuccgcuagcggggaggccgauacaaagauccucuuuaucgaagagggaaaaauuguucacaccuccacacugucuggcagcgcgcaacacguggaagagugcuccugcuauccucgcuaccccggggugagaugugucugccgggacaacuggaagggaagcaaccgcccuaucguggauauuaauaucaaggacuacucuauuguuuccagcuauguguguucuggccuugucggcgacacccccagaaagaacgauagcuccucuagcucccauugccuggacccgaauaacgaagaagggggacacggcgugaaagggugggccuucgaugacggaaaugauguuuggaugggccggacgaucagcgagaaacuccgcucuggguacgagacauuuaaggugaucgagggaugguccaacccuaauagcaaacugcagauuaacagacaggucaucguggaccggggcaaucgcucuggcuauuccgggauuuucagcgucgaaggaaaguccuguaucaacagaugcuuuuacguggagcugauucggggcagaaaagaagagaccgagguucucuggaccucuaauagcaucguggucuucugugggacauccggaaccuauggcacagggucuuggcccgauggcgcugacauuaaccugaugccuaucuga

SEQ ID NO: 198521 - RNA, 1413 nt, Artificial Sequence
  derived and/or modified sequence opt5 from neuraminidase__InfluenzaA__ABI95253
augaaccccaaucagaagaucauuaccaucggcagcauuuccaucgccauugggaucaucucuauuaugcugcaaaucggaaacauuaucagcauuugggcuucccacucuauccagacaggcagccagaaucauacggggauuugcaaccagagaaucaucaccuacgagaauagcacaugggugaaccacaccuaugucaauauuaacaauacaaacguuguggccggaaaagacaagaccucugugacacucgcgggcaauagcucccuguguagcaucucugggugggcuauuuacaccaaagauaacuccauccggauuggaagcaagggcgacgucuucgugauccgcgaaccuuuuaucucuugcucccaucuugaguguagaacguucuuucugacccaaggcgcccuccugaaugauaaacacagcaacgggacaguuaaggaccggucuccguaucgcgcccuuauguccugcccccugggagaagcuccuagccccuacaauuccaaguucgagucuguggccuggagcgcuuccgccugucaugauggcaugggguggcucaccauuggaaucagcggcccugacaacggggcggucgccgugcugaaauauaacggaauuaucacagaaaccauuaagucuuggaaaaagagaauccugcggacgcaggaguccgagugcguuugugugaauggcagcugcuuuacaaucaugaccgauggccccucugacggggcugccagcuacaaaauuuucaagaucgaaaagggaaaagucacaaaguccauugagcucaacgcuccuaauucucacuaugaagaguguagcugcuacccggauaccggcaccgugaugugugugugccgcgacaacuggcacggguccaauagacccugggucagcuuuaaccagaaucuggauuaccagaucggauauauuugcucuggcguuuucggggacaacccucggcccaaagauggagagggcuccuguaauccugugacaguggacggcgccgacggggucaagggauuuagcuacaaauauggcaacgggguguggaucggacgcacgaagucuaauagacuucggaaaggcuucgaaaugauuugggaucccaacggguggaccgacacagauuccgacuuuagcguuaagcaagauguggucgcgaucaccgacugguccggcuacucuggauccuucgugcagcauccggagcugacaggccucgauugcauccgcccuuguuuuuggguugaacuggugagagggcggccccgcgagaauaccacgauuuggacauccggaucuagcaucuccuucugcggcgucaacagcgacaccgccaauuggucuuggccugauggggcugaacuucccuucaccauugacaaguga

SEQ ID NO: 198522 - RNA, 1413 nt, Artificial Sequence; identical to SEQ ID NO: 198380
  derived and/or modified sequence opt5 from neuraminidase__InfluenzaA__ABI95264

SEQ ID NO: 198523 - RNA, 1413 nt, Artificial Sequence; identical to SEQ ID NO: 198380
  derived and/or modified sequence opt5 from neuraminidase__InfluenzaA__ABI95275

SEQ ID NO: 198524 - RNA, 1413 nt, Artificial Sequence; identical to SEQ ID NO: 198380
  derived and/or modified sequence opt5 from neuraminidase__InfluenzaA__ABI95286

SEQ ID NO: 198525 - RNA, 1413 nt, Artificial Sequence
  derived and/or modified sequence opt5 from neuraminidase__InfluenzaA__ABI95297
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaagaaucggucuccguaucgcgcccugauguccugcccccucggagaagcuccuagccccuacaacuccaaguucgagucuguggccuggagcgcuuccgccugucaugacggcaugggguggcugaccaucggaauuagcggcccugauaacggggcggucgccgugcugaaauauaauggaaucauuacagaaaccaucaagucuuggaaaaagcagauucucagaacgcaggaguccgagugcguuugugugaacggcagcugcuuuacaaucaugaccgacggccccucuaauggggcugccagcuacaaaaucuucaagauugaaaagggaaaagucacaaaguccaucgagcugaacgcuccuaauuuucacuaugaagaguguucuugcuacccggauaccggcaccgugaugugugugugccgggacaacuggcacgggagcaaucgccccugggucuccuucaaccagaaucuugauuaccaaauuggauauaucugcagcggcguuuuuggggacaacccuagacccaaagauggagagggcucuuguaauccugugacaguggacggcgccaacggggucaagggauucuccuacaaauauggcaaugggguguggauuggacggacgaaguccaaccgccugagaaaaggcuuugaaaugaucugggaucccaauggguggaccgacacagacucugauuucuccguuaagcaggacguggucgcgauuaccgauuggagcggcuacuccggaucuuuugugcagcauccggagcucacaggccuggacugcauccggccuuguuucuggguugaacuugugcgcgggcugcccaaggagaacaccacgaucuggacaagcggauccucuauuagcuucugcggcgucaacuccgauaccgccaauuggagcuggccugacggggcugaacuccccuuuaccaucgauaaauga

SEQ ID NO: 198526 - RNA, 1410 nt, Artificial Sequence; identical to SEQ ID NO: 197754
  derived and/or modified sequence opt5 from neuraminidase__InfluenzaA__ABI95308

SEQ ID NO: 198527 - RNA, 1413 nt, Artificial Sequence; identical to SEQ ID NO: 197410
  derived and/or modified sequence opt5 from neuraminidase__InfluenzaA__ABI96131

SEQ ID NO: 198528 - RNA, 1413 nt, Artificial Sequence; identical to SEQ ID NO: 197410
  derived and/or modified sequence opt5 from neuraminidase__InfluenzaA__ABI96133

SEQ ID NO: 198529 - RNA, 1413 nt, Artificial Sequence; identical to SEQ ID NO: 197410
  derived and/or modified sequence opt5 from neuraminidase__InfluenzaA__ABI96136

SEQ ID NO: 198530 - RNA, 1410 nt, Artificial Sequence
  derived and/or modified sequence opt5 from neuraminidase__InfluenzaA__ABJ09110
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucauucacaccagcucccuuucugggagcgcccaacacgucgaggaaugcuccuguuauccucgcuaccccggaguuagaugcgugugucgggacaacuggaagggcagcaaucgcccuaucguggauauuaacgucaaagacuacucuaucguguccagcuauguuugcucuggccuggugggggacacacccagaaagaaugauagcuccucuagcucccauugucucgacccgaacaaugaggaaggaggccacggggucaaaggaugggcuuucgaugacggcaacgauguguggauggggcggaccauuagcgagaagcugcgcucuggauacgagacguuuaaaguuaucgaaggcugguccaagccuaauagcaaacugcagaucaacagacaggugauugucgaccggggcaaucgcucuggguauuccggaaucuucagcguggaguccaagucuugcauuaacagauguuuuuacgucgaacucauccggggcagaaagcaggagacagaagugcuguggaccagcaauuccauuguuguguucugcgggaccucuggaacauauggcaccgggagcuggcccgauggcgccgacaucaaccuuaugccuauuuga

SEQ ID NO: 198531 - RNA, 1410 nt, Artificial Sequence; identical to SEQ ID NO: 198125
  derived and/or modified sequence opt5 from neuraminidase__InfluenzaA__ABJ09143

SEQ ID NO: 198532 - RNA, 1413 nt, Artificial Sequence; identical to SEQ ID NO: 197949
  derived and/or modified sequence opt5 from neuraminidase__InfluenzaA__ABJ09154

SEQ ID NO: 198533 - RNA, 1410 nt, Artificial Sequence; identical to SEQ ID NO: 197351
  derived and/or modified sequence opt5 from neuraminidase__InfluenzaA__ABJ09165

SEQ ID NO: 198534 - RNA, 1410 nt, Artificial Sequence; identical to SEQ ID NO: 197351
  derived and/or modified sequence opt5 from neuraminidase__InfluenzaA__ABJ09176

SEQ ID NO: 198535 - RNA, 1410 nt, Artificial Sequence; identical to SEQ ID NO: 197738
  derived and/or modified sequence opt5 from neuraminidase__InfluenzaA__ABJ09198

SEQ ID NO: 198536 - RNA, 1410 nt, Artificial Sequence; identical to SEQ ID NO: 197738
  derived and/or modified sequence opt5 from neuraminidase__InfluenzaA__ABJ09209

SEQ ID NO: 198537 - RNA, 1410 nt, Artificial Sequence
  derived and/or modified sequence opt5 from neuraminidase__InfluenzaA__ABJ09220
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccaaguaccggaauuggagcaaaccccagugcaagaucaccggguucgcgccuuuuuccaaggacaacucuauucgccuuagcgcuggaggcgauaucugggucacaagagagcccuauguguccugugacccugggaaaugcuaccaauucgcccugggacggggcaccacacucaauaaccgccauucuaaugauaccguucacgacagaacgccguaucggacacugcugaugaacgagcucggggugcccuuucaucugggaaccaagcaggucuguaucgccuggagcuccagcucuugccacgauggcaaggcuuggcuucauguguguguuacaggccacgacgaaaaugccaccgcuuccuucauuuacgaugggcgccugguggacagcaucggaucuugguccaaaaacauucucagaacccaggagagcgaaugcgucuguaucaauggcacaugcacgguggugaugaccgaugggucugccuccgagcgggcggacacaaaaauucuguuuaucgaggaaggaaagaucguccacauuagcccucuuuccggcucugcccagcauguugaggaaugcagcuguuauccccgcuacccuggggugagaugcgugugucgggauaacuggaagggauccaaccgccccaucgucgacauuaaugugaaagauuacagcaucguuucuuccuaugugugcagcggccuggucggcgacaccccgagaaagaacgacucuagcuccucuagcuacugucggaauccuaacaaugagaaagggucccacggagugaagggcugggcuuucgaugacgggaacgauguuuggaugggacgcacaauuagcgaggaacucagaucuggcuaugagaccuuuaaagugaucgggggaugguccaagcccaauagcaaacugcaaaucaaccggcaggucauuguggacagaggcaaucgcucuggcuacuccgggaucuucagcgucgaaggaaaguccugcauuaaccgguguuuuuauguggagcugaucagaggccgcaagcaggaaacggagguuugguggacaucuaauagcauuguggucuucugcgggaccuccggaaccuacggcacagggucuuggccugauggcgccgacaucaaccucaugcccauuuga

SEQ ID NO: 198538 - RNA, 1410 nt, Artificial Sequence; identical to SEQ ID NO: 197754
  derived and/or modified sequence opt5 from neuraminidase__InfluenzaA__ABJ09231

SEQ ID NO: 198539 - RNA, 1410 nt, Artificial Sequence; identical to SEQ ID NO: 197754
  derived and/or modified sequence opt5 from neuraminidase__InfluenzaA__ABJ09242

SEQ ID NO: 198540 - RNA, 1410 nt, Artificial Sequence; identical to SEQ ID NO: 197308
  derived and/or modified sequence opt5 from neuraminidase__InfluenzaA__ABJ09253

SEQ ID NO: 198541 - RNA, 1410 nt, Artificial Sequence
  derived and/or modified sequence opt5 from neuraminidase__InfluenzaA__ABJ09264
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguauaugacaaacaccacgaucgagaaggaaauuuguccuaaacucgccgaguaccggaauuggagcaagccccagugcaacaucaccggguucgcgccuuuuuccaaagacaauucuauucgccugagcgcuggaggcgauaucugggucacaagagagcccuauguguccugugacccugauaagugcuaccaauucgcccuugggcagggaaccacacugaacaaucggcauucuaacgacaccguucacgaucgcacgccguauagaacacuccugaugaaugaacugggcgugcccuuucaucucgggaccaagcaggucuguaucgccuggagcuccagcucuugccacgacggaaaagccuggcugcauguguguguuacaggccacgaugagaacgcuaccgcuuccuucauuuacaauggccggcuuguggacagcaucgggucuugguccaagaaaauucugcgcacccaggaaagcgagugcgucuguaucaacggaacaugcacgguggugaugaccgauggcucugccuccgggaaggcggacacaaaaauucucuuuaucgaggaaggaaagaucguccacauuagcccucuguccggcucugcccaacauguugaggaaugcagcuguuaucccagauacccuggggugcggugcgugugucgcgauaacuggaagggauccaauagacccaucgucgacauuaacgugaaagauuacagcaucguuucuuccuaugugugcagcggccuugucggcgacaccccgcggaagaaugacucuagcuccucuagccacugucugaacccuaauaacgaggaagggggacauggcgugaaagggugggcuuucgaugacggaaaugauguuuggaugggccgcacaauuuccgagaagcucagaagcggguacgagaccuuuaaagugaucgaaggauggucuaagcccaacuccaaacugcagaucaaucggcaggucauuguggaccgcggcaacagcucuggcuauuccgggaucuucagcgucgagggaaaguccugcauuaauagauguuuuuacguggaacugauccggggcagaaagcaggagacggaaguuugguggacaucuaacagcauugugguccucugcgggaccuccggaaccuauggcacagggucuuggccugauggcgccgacaucaaucugaugcccauuuga

SEQ ID NO: 198542 - RNA, 1410 nt, Artificial Sequence
  derived and/or modified sequence opt5 from neuraminidase__InfluenzaA__ABJ09286
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaagcugcgcagcggauacgagacguuuaaagugauugaaggcuggucuaagcccaauuccaaacugcagaucaacaagcaggucaucguggacagaggcaaucggagcggguauucuggaauuuucuccgucgagggcaagagcugcaucaaccgcuguuuuuacguggaacucauuagagggcggaaacaggagacagaaguucuguggaccuccaauucuaucguggucuucugcggaaccagcggcacauaugggaccggcuccuggccugauggagccgacauuaaccuuaugcccaucuga

SEQ ID NO: 198543 - RNA, 1410 nt, Artificial Sequence; identical to SEQ ID NO: 197308
  derived and/or modified sequence opt5 from neuraminidase__InfluenzaA__ABJ09308

SEQ ID NO: 198544 - RNA, 1410 nt, Artificial Sequence; identical to SEQ ID NO: 198512
  derived and/or modified sequence opt5 from neuraminidase__InfluenzaA__ABJ09319

SEQ ID NO: 198545 - RNA, 1413 nt, Artificial Sequence; identical to SEQ ID NO: 197977
  derived and/or modified sequence opt5 from neuraminidase__InfluenzaA__ABJ09330

SEQ ID NO: 198546 - RNA, 1410 nt, Artificial Sequence
  derived and/or modified sequence opt5 from neuraminidase__InfluenzaA__ABJ09341
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuucuggggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccggggcaaucgcagcggguauucuggaauuuucuccgucgagagcaaguccugcaucaacagauguuuuuacguggaacugauucggggcagaaagcaggagacagaaguucuuuggaccucuaauagcaucguggucuucugcgggaccuccggaacauauggcaccgggucuuggcccgauggcgccgacauuaaccugaugccuaucuga

SEQ ID NO: 198547 - RNA, 1410 nt, Artificial Sequence
  derived and/or modified sequence opt5 from neuraminidase__InfluenzaA__ABJ09352
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgggcggacgccguaucgcacacugcugaugaaugaacucggagugcccuuucaucugggcaccaagcaggucuguaucgccuggagcuccagcucuugccacgauggcaaagccuggcuucauguguguguuacaggggacgaugagaacgcuaccgcuuccuucauuuacaauggaagacugguggacagcaucggcucuugguccaagaaaauucuccggacccaggaaagcgagugcgucuguaucaacgggacaugcacgguggugaugaccgauggaucugccuccggcaaggcggacacaaaaauucuguuuaucgaggaagggaagaucguccacaccagcucccuuucuggaagcgcccaacacguugaggaaugcuccuguuauccucgcuaccccggcgugagaugcgugugucgggauaacuggaagggcagcaaucgcccuauugucgacaucaacgugaaagauuacucuauuguuuccagcuaugugugcucugggcuggucggagacacacccagaaagaaugacagcuccucuagcucccauugucucgauccgaacaaugaggaaggcgggcacggagugaaaggcugggcuuucgacgaugggaacgacguuuggaugggacggaccaucagcgagaagcugcgcucuggcuacgagacguuuaaagugauugaaggcugguccaagccuaauagcaaacugcagaucaacagacaggucaucguggaucgggggaaucgcucuggauauuccggcauuuucagcgucgaguccaagucuugcaucaacagauguuuuuacguggaacucauucgggggagaaagcaggagacagaaguucuguggaccagcaauuccaucguggucuucugcggaaccucuggcacauaugggaccggcagcuggcccgacggagccgauauuaaccuuaugccuaucuga

SEQ ID NO: 198548 - RNA, 1407 nt, Artificial Sequence
  derived and/or modified sequence opt5 from neuraminidase__InfluenzaA__ABJ09374
augauccagagcaagauuaucaccauuggcuccgugucucugacaaucagcacgauuugcuucuuuaugcaaaucgccauccucauuaccacagucacccugcacuucaaacaguacgaguuuaacagcccgccuaauaaccagguuaugcuuugugaaccgacaaucauugagagaaauaucaccgaaauuguguaucugacaaacaccacgaucgagaaggaaauuugccccaaacucgcugaguaccggaauuggucuaagccucagugugacaucaccggguucgcccccuuuagcaaagauaacuccauccgccugucugcgggaggcgacauuugggugacaagagagccuuaugucagcugcgaucccgacaaguguuaccaauucgcucuugggcagggaaccacacugaauaacgugcauuccaaugauaccguucacgaccggacgccuuaucgcacacuccugaugaacgaacugggcgugccguuucaucucgggaccaagcaggucugcaucgccugguccucuuccagcugucacgauggaaaagccuggcugcaugugugcguuacaggcgacgauaagaaugcuaccgccucuuucauuuacaacggcagacuuguggacuccaucgucagcuggucuaaaaagauucugcggacccaggaguccgaaugugugugcaucaaugggacauguacgguggucaugaccgauggaagcgcuuccggcaaagccgacacaaagauccucuuuauugaggaggggaagaucguucacaccucuacacugagcggauccgcgcaacacguggaagagugcagcugcuauccccgcuacccuggcgugagaugugucugccgggauaacuggaaagggucuaaucgccccauuguggacaucaacauuaaggacuacuccaucguuagcucuuauguguguagcggacuugucggcgauaccccucggaaaaacgacuccucuagcuccagccauugccuggaucccaauaacgaagagggcgggcacggagugaagggcugggccuucgacgaugggaaugacguuuggaugggaagaacgaucucugaaaaacuccgcuccggcuacgagacauuuaaggugauugagggguggagcaaccccaauucuaaacugcagaucaacagacaggucauuguggaucggggaaaucgcuccggcuauagcggcaucuucuccgucgaagggaagucuuguauuaacagaugcuuuuacguggagcugauccggggaaagaaagaagagaccgaaguucucuggaccagcaauuccauuguggucuucuguggcacaucugggaccuauggaacaggcagcuggccugacggggcugauaucaaccugaugcccaucuga

SEQ ID NO: 198549 - RNA, 1410 nt, Artificial Sequence; identical to SEQ ID NO: 197738
  derived and/or modified sequence opt5 from neuraminidase__InfluenzaA__ABJ09385

SEQ ID NO: 198550 - RNA, 1410 nt, Artificial Sequence; identical to SEQ ID NO: 197277
  derived and/or modified sequence opt5 from neuraminidase__InfluenzaA__ABJ16590

SEQ ID NO: 198551 - RNA, 1410 nt, Artificial Sequence; identical to SEQ ID NO: 198542
  derived and/or modified sequence opt5 from neuraminidase__InfluenzaA__ABJ16601

SEQ ID NO: 198552 - RNA, 1413 nt, Artificial Sequence
  derived and/or modified sequence opt5 from neuraminidase__InfluenzaA__ABJ16612
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccgugggaaucagcggcccugacaacggggcgguugccgugcugaaauauaacggaaucauuacagaaaccaucaagucuuggaaaaagcggauucucagaacgcaggaguccgagugcgucugugugaauggcagcugcuuuacaaucaugaccgauggccccucuaacggggcugccagcuacaaaauuuucaagaucgaaaagggaaaagugacaaaguccaucgagcugaaugcuccuaacuuucacuaugaagaguguucuugcuacccggacaccggcaccgucauguguguuugccgcgauaauuggcacgggagcaacagacccuggguguccuucaaucagaaccuugacuaccagauuggauauaucugcagcggcguguuuggggauaauccucggcccaaagacggagagggcucuuguaacccugucacaguggauggcgccgacgggguuaagggauucuccuacaaauauggcaaugggguguggauuggacgcacgaaguccaacagacugcggaaaggcuuugaaaugaucugggaccccaauggguggaccgauacagacucugauuucuccgucaagcaagacgugguugcgauuaccgauuggagcggcuacuccggaucuuuugugcagcauccggagcucacaggccuggacugcauccgcccuuguuucugggucgaacuugugagagggcugccccgggagaacaccacgauuuggacaagcggauccucuaucagcuucugcggcgucaauuccgauaccgccaacuggagcuggccugacggggcugaacuccccuuuaccaucgauaaguga

SEQ ID NO: 198553 - RNA, 1410 nt, Artificial Sequence; identical to SEQ ID NO: 198542
  derived and/or modified sequence opt5 from neuraminidase__InfluenzaA__ABJ16623

SEQ ID NO: 198554 - RNA, 1410 nt, Artificial Sequence
  derived and/or modified sequence opt5 from neuraminidase__InfluenzaA__ABJ16634
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacauuaccaucgagaaggaaauuugcccuaaacucgcugaguaccggaauugguccaagccccagugugacaucacgggguucgccccuuuuucuaaagauaacagcauccgccuguccgcgggaggcgacauuugggugaccagagagcccuaugucucuugcgauccugacaaguguuaccaauucgcucuugggcagggaacaacccugaauaacgugcauagcaaugauacaguucacgaccggaccccguaucgcacgcuccugaugaacgaacugggcgugcccuuucaucucgggacaaagcaggucugcaucgccugguccucuagcuccugucacgauggaaaagccuggcugcaugugugcguuaccggcgacgauaagaaugcuacagccagcuucauuuacaacggcagacuuguggacucuaucgucuccuggagcaaaaagauucugcggacccaggagucugaaugugugugcaucaaugggaccuguacaguggucaugacggauggauccgcuagcggcaaagccgacaccaagauccucuuuauugaggaggggaagaucguucacacauccacccugucuggaagcgcgcaacacguggaagagugcuccugcuauccucgcuaccccggcgugagaugugucugccgggauaacuggaaagggagcaaccgcccuauuguggacaucaauauuaaggacuacucuaucguuuccagcuauguguguucuggacuugucggcgauacaccccggaaaaacgacagcuccucuagcucccauugccuggauccgaauaacgaagagggcgggcacggagugaagggcugggccuucgacgaugggaaugacguuuggaugggaagaaccaucagcgaaaaacuccgcucuggcuacgagacguuuaaggugauugaggggugguccaacccuaauagcaaacugcagaucaacagacaggucauuguggaucggggaaaucgcucuggcuauuccggcaucuucagcgucgaagggaaguccuguauuaacagaugcuuuuacguggagcugauccggggaagaaaggaagagacagaaguucucuggaccucuaauagcauuguggucuucuguggcaccuccgggacauauggaaccggcucuuggcccgacggggcugauaucaaccugaugccuaucuga

SEQ ID NO: 198555 - RNA, 1413 nt, Artificial Sequence; identical to SEQ ID NO: 197410
  derived and/or modified sequence opt5 from neuraminidase__InfluenzaA__ABJ16656

SEQ ID NO: 198556 - RNA, 1413 nt, Artificial Sequence; identical to SEQ ID NO: 197410
  derived and/or modified sequence opt5 from neuraminidase__InfluenzaA__ABJ16667

SEQ ID NO: 198557 - RNA, 1413 nt, Artificial Sequence
  derived and/or modified sequence opt5 from neuraminidase__InfluenzaA__ABJ16678
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuuccucguuaagcaagacguggucgcgauuaccgauugguccggcuacagcggauccuuugugcagcauccggaacugacaggccuugacugcauccgcccuuguuucuggguugagcuggugagagggcucccccgggaaaacaccacgaucuggacaucuggaagcuccauuucuuucugcggcgucgauagcgacaccgccaauugguccuggccugauggggcugagcugcccuuuaccaucgacaaauga

SEQ ID NO: 198558 - RNA, 1413 nt, Artificial Sequence; identical to SEQ ID NO: 197410
  derived and/or modified sequence opt5 from neuraminidase__InfluenzaA__ABJ16689

SEQ ID NO: 198559 - RNA, 1410 nt, Artificial Sequence
  derived and/or modified sequence opt5 from neuraminidase__InfluenzaA__ABJ16700
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgaguccaagucuugcaucaacagauguuuuuacguggaacucauucggggcaagaaacaggagacagaaguucuguggaccagcaauuccaucguggucuucugcgggaccucuggaacauauggcaccgggagcuggcccgauggcgccgacauuaaccuuaugccuaucuga

SEQ ID NO: 198560 - RNA, 1410 nt, Artificial Sequence
  derived and/or modified sequence opt5 from neuraminidase__InfluenzaA__ABJ16711
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuggugggggacacacccagaaagaaugauagcuccucuagcucccauugucucgacccgaacaaugaggaaggaggccacggggucaaaggaugggcuuucgaugacggcaacgaugccuggauggggcggaccauuagcgagaagcugcgcucuggauacgagacguuuaaagugaucgaaggcugguccaagagcaauucuaaacugcagaucaacagacagguuauuguggaccggggcaaucgcuccggguauagcggaaucuucuccgucgagggcaagucuugcauuaacagauguuuuuacguggaacucauccgggggagaaagcaggagacagaaguccuguggaccagcaauuccauugugguuuucugcggaaccucuggcacauaugggaccggcagcuggccugauggagcugacaucaaccuuaugcccauuuga

SEQ ID NO: 198561 - RNA, 1413 nt, Artificial Sequence
  derived and/or modified sequence opt5 from neuraminidase__InfluenzaA__ABJ16733
augaaccccaaucagaagaucauuaccaucggcagcauuuccguggccaucgggauuaucaaccugauccuccaaauuggaaauaucauuucuaucugggcuagccacuccauucagacaggcucucagaacuacacggggaucugcaaucagagaauuaucaccuaugagaaccggacaugggucaaucaaaccuacguuaacaucaauaacacaaaugugguggccggaaaagacaagaccagcaugacacuggcgggcaacuccucucuuuguccuauucgcgggugggcuaucuauaccaaagauaauagcauuagaaucggauccaagggcgacauuuucgucauccgggaaccguuuaucagcugcucucaucuggagugucgcacguucuuucucacccagggcgcccugcuuaacgauaaacacuccaaugggacaauuaaggacagaagccccuuccgggcccugaugucuugcccucucggagaagcucccuccccuuacaacagccgcuuugagucuguggccugguccgcuagcgccugucaugauggccugggguggcugaccaucggaauuuccggccccgacaacggggcgguugccgugcucaaguauaauggaaucauuacagaaaccaucaaaucuuggaagaaacagauccugagaacgcaggagagcgagugcgucugugugaacggcuccugcuucacaauuaugaccgauggcccuagcaaucgggcugccucuuaccgcaucuuuaagauugaaaaagggagaguuacaaaguccaucgagcuugacgcuccgaacuaucacuacgaagaguguagcugcuaccccgauaccggaaccgugaugugugucugccgggacaauuggcauggcucuaaccgcccuugggugagcuucaaucaaaaccuggauuaucagauuggguacaucugcuccggaguguuuggcgacaaucccagaccuaaggauggggagggaucuuguaaccccgucacaguugacggcgccgacggcgugaaaggguucagcuaucgguacggaaauggcguguggauugggcgcacgaaguccaacagacuccggaaaggauuugaaaugaucugggauccgaauggcuggaccgacacagauagcgacuucucuaugaagcaggaugucguggcgaugaccgacugguccggguauagcggcucuuuuguucagcacccugagcugacaggacuugauugcaugagacccuguuucuggguggaacugguccgcggccucccucgggagaacaccacgaucuggacauccgggagcuccauuucuuucugcggagugaauagcgaaaccgccaacugguccuggcccgacggcgcugagcugcccuuuaccaucgauaaauga

SEQ ID NO: 198562 - RNA, 1410 nt, Artificial Sequence; identical to SEQ ID NO: 197754
  derived and/or modified sequence opt5 from neuraminidase__InfluenzaA__ABJ16744

SEQ ID NO: 198563 - RNA, 1410 nt, Artificial Sequence; identical to SEQ ID NO: 197754
  derived and/or modified sequence opt5 from neuraminidase__InfluenzaA__ABJ16755

SEQ ID NO: 198564 - RNA, 1410 nt, Artificial Sequence; identical to SEQ ID NO: 197754
  derived and/or modified sequence opt5 from neuraminidase__InfluenzaA__ABJ16766

SEQ ID NO: 198565 - RNA, 1410 nt, Artificial Sequence
  derived and/or modified sequence opt5 from neuraminidase__InfluenzaA__ABJ16777
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuggugggggacacacccagaaagaaugauagcuccucuagcucccauugucucgacccgaacaaugaggaaggaggccacggggucaaaggaugggcuuucgaugacggcaacgauguguggauggggcggaccauuagcgagaagcugcgcucuggauacgagacguuuaaaguuaucgaaggcugguccaagccuaauagcaaacugcagaucaacagacaggugauugucgaccggggcaaucgcucuggguauuccggaaucuucagcguggagggcaaguccugcauuaacagauguuuuuacgucgaacucauccgggggagaaagcaggagacagaagugcuguggaccucuaauagcauuguuguguucugcggaaccuccggcacauaugggaccggcucuuggcccgauggagccgacaucaaccuuaugccuauuuga

SEQ ID NO: 198566 - RNA, 1410 nt, Artificial Sequence; identical to SEQ ID NO: 197754
  derived and/or modified sequence opt5 from neuraminidase__InfluenzaA__ABJ16788

SEQ ID NO: 198567 - RNA, 1413 nt, Artificial Sequence; identical to SEQ ID NO: 197992
  derived and/or modified sequence opt5 from neuraminidase__InfluenzaA__ABJ53441

SEQ ID NO: 198568 - RNA, 1413 nt, Artificial Sequence
  derived and/or modified sequence opt5 from neuraminidase__InfluenzaA__ABJ53452
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuauugccggaaaagacaagaccucugugacacuggcgggcaauagcucccuuuguagcaucucugggugggcuauuuacaccaaagauaacuccauccggauuggaagcaagggcgacguguucgucauccgcgaaccuuuuaucucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucuguugccuggagcgcuuccgccugucaugauggcaugggguggcugaccauuggaaucagcggcccugacaacggggcgguggccguccugaaauauaacggaauuaucacagaaaccauuaagucuuggaaaaagagaauccuccggacgcaggaguccgagugcguguguguuaauggcagcugcuuuacaaucaugaccgauggccccucuaacggggcugccagcuacaaaauuuucaagaucgaaaagggaaaagugacaaaguccauugagcugaaugcuccuaacuuucacuaugaagaguguucuugcuacccggacaccggcaccgucaugugugugugccgcgauaauuggcacgggagcaacagacccuggguguccuucaaucagaaccuugacuaccagaucggauauauuugcagcggcgucuuuggggauaauccucggcccaaagacggagagggcucuuguaacccuguuacaguggauggcgccgacggggugaagggauucuccuacaaauauggcaauggggucuggaucggacgcacgaaguccaacagacugcggaaaggcuuugaaaugauuugggaccccaauggguggaccgauacagacucuaacuucuccgugaagcaagauguuguggcgaucaccgacuggagcggcuacuccggaucuuuuguccagcauccggagcucacaggccuggauugcauccgcccuuguuucuggguggaacuuguuagagggcugccccgggagaauaccacgauuuggacaagcggauccucuaucagcuucugcggcgugaacuccgacaccgccaacuggagcuggccugauggggcugaacuccccuuuaccauugacaaguga

SEQ ID NO: 198569 - RNA, 1410 nt, Artificial Sequence; identical to SEQ ID NO: 197736
  derived and/or modified sequence opt5 from neuraminidase__InfluenzaA__ABJ53463

SEQ ID NO: 198570 - RNA, 1410 nt, Artificial Sequence; identical to SEQ ID NO: 197736
  derived and/or modified sequence opt5 from neuraminidase__InfluenzaA__ABJ53474

SEQ ID NO: 198571 - RNA, 1410 nt, Artificial Sequence
  derived and/or modified sequence opt5 from neuraminidase__InfluenzaA__ABJ53485
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauuccaacagcaagcugcagaccaauagacaggucauuguggaccggggaaaccgcucuggcuauuccggcaucuucagcgucgaggggaaauccuguauuaauagaugcuuuuacguggaacucauccggggaagaaaggaggaaaccgagguucuguggacaucuaacagcauuguggucuucuguggcaccuccgggacauauggaacgggcucuuggccugauggggcugacaucaaucuuaugcccauuuga

SEQ ID NO: 198572 - RNA, 1413 nt, Artificial Sequence; identical to SEQ ID NO: 198380
  derived and/or modified sequence opt5 from neuraminidase__InfluenzaA__ABJ53496

SEQ ID NO: 198573 - RNA, 1413 nt, Artificial Sequence; identical to SEQ ID NO: 198380
  derived and/or modified sequence opt5 from neuraminidase__InfluenzaA__ABJ53507

SEQ ID NO: 198574 - RNA, 1413 nt, Artificial Sequence
  derived and/or modified sequence opt5 from neuraminidase__InfluenzaA__ABJ53518
augaaccccaaucagaagaucauuaccaucggcagcauuuccguggccaucgggauuaucaaccugauccuccaaauuggaaauaucauuucuaucugggcuagccacuccauucagacaggcucucagaacuacacggggaucugcaaucagagaauuaucaccuaugagaaccggacaugggucaaucaaaccuacguuaacaucaauaacacaaaugugguggccggaaaagacaagaccagcaugacacuggcgggcaaccuuucccuguguccuauucgcgggugggcuaucuauaccaaagauaauucuauuagaaucggaagcaagggcgacgucuucgugauucgggaaccguuuaucuccugcagccaucucgagugucgcacguucuuucugacccagggcgcccuucugaacgauaaacacucuaaugggacaaucaaggacagaucccccuuccgggcccucaugagcugcccucugggagaagcucccucuccuuacaacucccgcuuugagagcguugccuggucugcuuccgccugucaugauggccugggguggcucaccauuggaaucagcggccccgacaacggggcgguggccguccugaaguauaauggaauuaucacagaaaccauuaaauccuggaagaaacagauccuuagaacgcaggagucugagugcguguguguuaacggcagcugcuucacaaucaugaccgauggcccuuccaaucgggcugccagcuaccgcauuuuuaagaucgaaaaagggagagugacaaagucuauugagcuggacgcuccgaacuaucacuacgaagaguguuccugcuaccccgauaccggaaccgucaugugugugugccgggacaauuggcauggcagcaaccgcccuugggugucuuucaaucaaaaccucgauuaucagaucggguacauuugcagcggagucuuuggcgacaaucccagaccuaaggauggggagggauccuguaaccccguuacaguggacggcgccgacggcgugaaaggguucucuuaucgguacggaaauggcgucuggaucgggcgcaccaagagcaacagacugcggaaaggauuugaaaugauuugggauccgaauggcuggacggacacagauuccgacuucagcaugaagcaggaugugguugcgaugaccgacuggucuggguauuccggcagcuuugugcagcacccugagcuuacaggacuggauugcaugagacccuguuucugggucgaacucgugcgcggccugccucgggagaacaccacgaucuggacaucuggguccagcaucuccuucugcggaguuaauucugaaaccgccaacuggagcuggcccgacggcgcugagcugcccuuuaccauugauaaauga

SEQ ID NO: 198575 - RNA, 1410 nt, Artificial Sequence; identical to SEQ ID NO: 197178
  derived and/or modified sequence opt5 from neuraminidase__InfluenzaA__ABK39965

SEQ ID NO: 198576 - RNA, 1410 nt, Artificial Sequence
  derived and/or modified sequence opt5 from neuraminidase__InfluenzaA__ABK39976
augaaccccaaucagaagaucauuaccaucggcagcgugucccugacaauuucuacgaccugcuucuuuaugcaaaucgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccaguguaacaucacaggguucgccccuuuuucuaaagacaauagcauucgccuguccgcgggaggcgauaucugggugaccagagagcccuaugucucuugcgacccugauaaguguuaccaauucgcucuugggcagggaacaacccugaacaaugugcauagcaacgacacgguucacgaucggacaccguaucgcacccuccugaugaaugaacugggcgugcccuuucaucucgggacaaagcaggucugcaucgccugguccucuagcuccugucacgacggaaaagccuggcugcaugugugcguuaccggcgaugacaagaacgcuaccgccagcuucauuuacaauggcagacuuguggauucuaucgucuccuggagcaaagagauucugcggacacaggaaucugagugugugugcaucaacgggacgugugcuguggucaugaccgacggauccgccagcggcaaggcggauacaaaaauucucuuuaucgaggaagggaagaucguucacaccuccacacugucuggaagcgcccaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacccccagaaagaaugauagcuccucuagcucccauugccuggacccgaacaaugaggaaggcgggcacggagugaaaggcugggcuuucgaugacgggaacgauguuuggaugggacggacgauuagcgagaagcuccgcucuggcuacgagacauuuaaagugaucgaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggaccucuaacagcauuguggucuucuguggcacauccgggaccuauggaacaggcucuuggcccgauggggccgacaucaaucugaugccuauuuga

SEQ ID NO: 198577 - RNA, 1410 nt, Artificial Sequence; identical to SEQ ID NO: 197736
  derived and/or modified sequence opt5 from neuraminidase__InfluenzaA__ABK39987

SEQ ID NO: 198578 - RNA, 1410 nt, Artificial Sequence; identical to SEQ ID NO: 197406
  derived and/or modified sequence opt5 from neuraminidase__InfluenzaA__ABK39998

SEQ ID NO: 198579 - RNA, 1410 nt, Artificial Sequence; identical to SEQ ID NO: 197351
  derived and/or modified sequence opt5 from neuraminidase__InfluenzaA__ABK40020

SEQ ID NO: 198580 - RNA, 1413 nt, Artificial Sequence
  derived and/or modified sequence opt5 from neuraminidase__InfluenzaA__ABK40031
augaaccccaaucagaagaucauuaccaucggcagcauuuccguggccaucgggauuaucaaccugauccuccaaauuggaaauaucauuucuaucugggcuagccacuccauucagacaggcucucagaacuacacggggaucugcaaucagagaauuaucaccuaugagaaccggacaugggucaaucaaaccuacguuaacaucaauaacacaaaugugguggccggaaaagacaagaccagcaugacacuggcgggcaacuccucucuuuguccuauucgcgggugggcuaucuauaccaaagauaauagcauuagaaucggauccaagggcgacgucuucgugauucgggaaccguuuaucagcugcucucaucuggagugucgcacguucuuucucacccagggcgcccugcuuaacgauaaacacuccaaugggacaaucaaggacagaagccccuuccgggcccugaugucuugcccucucggagaagcucccuccccuuacaacagccgcuuugagucuguugccugguccgcuagcgccugucaugauggccugggguggcugaccauuggaaucuccggccccgacaacggggcgguggccguccucaaguauaauggaauuaucacagaaaccauuaaaucuuggaagaaacagauccugagaacgcaggagagcgagugcguguguguuaacggcuccugcuucacaaucaugaccgauggcccuagcaaucgggcugccucuuaccgcauuuuuaagaucgaaaaagggagagugacaaaguccauugagcuugacgcuccgaacuaucacuacgaagaguguagcugcuaccccgauaccggaaccgucaugugugugugccgggacaauuggcauggcucuaaccgcccuugggugagcuucaaucaaaaccuggauuaucagaucggguacauuugcuccggagucuuuggcgacaaucccagaccuaaggauggggagggaucuuguaaccccguuacaguggacggcgccgacggcgugaaaggguucagcuaucgguacggaaauggcgucuggaucgggcgcacgaaguccaacagacuccggaaaggauuugaaaugauuugggauccgaauggcuggaccgacacagauagcgacuucucuaugaagcaggaugugguugcgaugaccgacugguccggguauagcggcucuuuugugcagcacccugagcugacaggacuugauugcaugagacccuguuucugggucgaacuggugcgcggccucccucgggagaacaccacgaucuggacauccgggagcuccaucucuuucugcggaguuaauagcgaaaccgccaacugguccuggcccgacggcgcugagcugcccuuuaccauugauaaauga

SEQ ID NO: 198581 - RNA, 1413 nt, Artificial Sequence; identical to SEQ ID NO: 198580
  derived and/or modified sequence opt5 from neuraminidase__InfluenzaA__ABK40042

SEQ ID NO: 198582 - RNA, 1413 nt, Artificial Sequence; identical to SEQ ID NO: 198580
  derived and/or modified sequence opt5 from neuraminidase__InfluenzaA__ABK40053

SEQ ID NO: 198583 - RNA, 1410 nt, Artificial Sequence; identical to SEQ ID NO: 197754
  derived and/or modified sequence opt5 from neuraminidase__InfluenzaA__ABK40064

SEQ ID NO: 198584 - RNA, 1410 nt, Artificial Sequence; identical to SEQ ID NO: 197754
  derived and/or modified sequence opt5 from neuraminidase__InfluenzaA__ABK40078

SEQ ID NO: 198585 - RNA, 1413 nt, Artificial Sequence; identical to SEQ ID NO: 198083
  derived and/or modified sequence opt5 from neuraminidase__InfluenzaA__ABK40513

SEQ ID NO: 198586 - RNA, 1413 nt, Artificial Sequence; identical to SEQ ID NO: 198083
  derived and/or modified sequence opt5 from neuraminidase__InfluenzaA__ABK40538

SEQ ID NO: 198587 - RNA, 1413 nt, Artificial Sequence
  derived and/or modified sequence opt5 from neuraminidase__InfluenzaA__ABK40549
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagcuaccgcauuuucaagaucgaaaaaggaaagauuaccaaaucuaucgagcucgaugcccccaacagccauuaugaagagugcuccuguuacccugacaccggcacagugaugugcgugugcagagauaauuggcacgggucuaaccggcccugggucagcuuuaaucagaaccuggacuacaagauuggauauaucuguuccggcguuuucggggauaauccucgccccaaggacggaaaaggcagcugcgacccggugacgguggauggcgcugacggggucaagggauuuucuuacagauauggcaacgggguguggauuggacggaccaaauccaauagcucucgcaagggcuucgagaugaucugggauccuaacggguggacagacaccgauuccaauuuucuuguuaaacaagacguggucgccaugacagauuggagcggcuacuccggaucuuucgugcagcaccccgaacugaccggccucgacuguaugagaccuugcuuuuggguugagcugauccgggggagaccccgcgaaaagacgacaauuuggaccagcggauccucuaucagcuucuguggcgugaacuccgauaccgcuaauuggagcuggcccgacggggccgagcuuccuuucacaauugauaaauga

SEQ ID NO: 198588 - RNA, 1413 nt, Artificial Sequence; identical to SEQ ID NO: 198083
  derived and/or modified sequence opt5 from neuraminidase__InfluenzaA__ABK40560

SEQ ID NO: 198589 - RNA, 1413 nt, Artificial Sequence; identical to SEQ ID NO: 198083
  derived and/or modified sequence opt5 from neuraminidase__InfluenzaA__ABK40571

SEQ ID NO: 198590 - RNA, 1413 nt, Artificial Sequence; identical to SEQ ID NO: 198083
  derived and/or modified sequence opt5 from neuraminidase__InfluenzaA__ABK40582

SEQ ID NO: 198591 - RNA, 1413 nt, Artificial Sequence
  derived and/or modified sequence opt5 from neuraminidase__InfluenzaA__ABK40593
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagccaucgcauuuucaagaucgaaaaaggaaagauuaccaaaucuaucgagcucgaugcccccaacagccacuacgaagagugcuccuguuauccugacaccggcacagugaugugcgugugcagagauaauuggcacgggucuaaccggcccugggucagcuuuaaucagaaccuggacuacaagauuggauacaucuguuccggcguuuucggggauaauccucgccccaaggacggaaaaggcagcugcgacccggugacgguggauggcgcugacggggucaagggauuuucuuauagauacggcaacgggguguggauuggacggaccaaauccaauagcucucgcaagggcuucgagaugaucugggauccuaacggguggacagacaccgauuccaauuuucuuguuaaacaagacguggucgccaugacagauuggagcggcuauuccggaucuuucgugcagcaucccgaacugaccggccucgacuguaugagaccuugcuuuuggguugagcugauccgggggagaccccgcgaaaagacgacaauuuggaccagcggauccucuaucagcuucuguggcgugaacuccgauaccgcuaauuggagcuggcccgacggggccgagcuuccuuucacaauugauaaauga

SEQ ID NO: 198592 - RNA, 1413 nt, Artificial Sequence; identical to SEQ ID NO: 198083
  derived and/or modified sequence opt5 from neuraminidase__InfluenzaA__ABK40604

SEQ ID NO: 198593 - RNA, 1410 nt, Artificial Sequence; identical to SEQ ID NO: 197754
  derived and/or modified sequence opt5 from neuraminidase__InfluenzaA__ABK40615

SEQ ID NO: 198594 - RNA, 1410 nt, Artificial Sequence; identical to SEQ ID NO: 197085
  derived and/or modified sequence opt5 from neuraminidase__InfluenzaA__ABK40626

SEQ ID NO: 198595 - RNA, 1410 nt, Artificial Sequence
  derived and/or modified sequence opt5 from neuraminidase__InfluenzaA__ABK40648
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugggaagugcuaccaauucgcccugggacagggcaccacacucaauaaccggcauucuaaugauaccguucacgaccgcacgccguauagaacacugcugaugaacgaacucgggauccccuuucaucugggaaccaaacagguguguauugccuggagcuccagcucuugccacgauggcaaggcuuggcuucaugucugugugacaggccacgacgagaaugccaccgcuuccuucaucuacgaugggcggcugguugacagcauuggaucuugguccaaaaacauccuccgcacccaggaaagcgagugcguguguauuaauggcacaugcacggucgugaugaccgaugggucugccuccgacagagcggauacaaagauccuguuuaucgaggaaggaaaaauugugcacaucagcccucuuuccggcucugcccaacaugucgaggaaugcagcuguuauccccgguacccugggguucgcugcguguguagagacaacuggaagggauccaaccggcccauuguggauaucaaugucaaggacuacagcauugugucuuccuauguuugcagcggccuggugggcgacaccccgcgcaaaaacgauucuagcuccucuagcuacuguuggaauccuaacaaugagaaagggggacacggcgucaaggggugggcuuucgacgauggaaacgacguguggaugggcagaacaaucuccgaagagagccggucuggguaugagaccuuuaagguuaucggaggcugguccaaacccaauagcaagcuccagauuaaccgccaggugaucgucgauagaggcaaucggucuggguacuccggaauuuucagcguggaaggcaaauccugcaucaacagauguuuuuaugucgagcugauucgcgggcggaagcaggaaacggaggugugguggacaucuaauagcaucguuguguucugcggaaccuccggcaccuacgggacaggcucuuggccugacggagccgauauuaaccugaugcccaucuga

SEQ ID NO: 198596 - RNA, 1410 nt, Artificial Sequence; identical to SEQ ID NO: 198137
  derived and/or modified sequence opt5 from neuraminidase__InfluenzaA__ABK40659

SEQ ID NO: 198597 - RNA, 1410 nt, Artificial Sequence; identical to SEQ ID NO: 198125
  derived and/or modified sequence opt5 from neuraminidase__InfluenzaA__ABK40681

SEQ ID NO: 198598 - RNA, 1413 nt, Artificial Sequence
  derived and/or modified sequence opt5 from neuraminidase__InfluenzaA__ABK40692
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuugggagaaacggauucucagaacgcaggaguccgaaugcguuugugugaauggcagcugcuuuacaaucaugaccgauggccccucuaacggggcugccagcuacaagaucuucaaaauugagaagggaaaggucacaaaauccguggaacugaaugcuccuaacuuucacuaugaggaguguucuugcuacccggacaccggcaccgugaugugugucugccgcgauaauuggcacgggagcaacagacccuggguuuccuucaaucagaaccuugacuaccagaucggauauauuugcagcggcguguuuggggauaauccucggcccaaggacggaaaaggcucuuguaacccugugacagucgauggcgccgacggggugaagggauucuccuacaaauauggcaaugggguuuggaucggacgcacgaaguccaacagacugcggaaaggcuuugaaaugauuugggaccccaauggguggaccgauacagacucugauuucuccgugaagcaagacgucguggcgaucaccgauuggagcggcuacuccggaucuuuuguucagcauccggagcucacaggccuggacugcauucgcccuuguuucuggguggaacuugucagagggcugccccgggagaacaccacgaucuggacaagcggauccucuaucagcuucugcggcguggauuccgacaccgccaauuggagcuggccugauggggcugaacuccccuuuaccauugacaaguga

SEQ ID NO: 198599 - RNA, 1410 nt, Artificial Sequence; identical to SEQ ID NO: 197754
  derived and/or modified sequence opt5 from neuraminidase__InfluenzaA__ABK40703

SEQ ID NO: 198600 - RNA, 1410 nt, Artificial Sequence; identical to SEQ ID NO: 197754
  derived and/or modified sequence opt5 from neuraminidase__InfluenzaA__ABK40714

SEQ ID NO: 198601 - RNA, 1410 nt, Artificial Sequence; identical to SEQ ID NO: 197754
  derived and/or modified sequence opt5 from neuraminidase__InfluenzaA__ABK40725

SEQ ID NO: 198602 - RNA, 1410 nt, Artificial Sequence; identical to SEQ ID NO: 197754
  derived and/or modified sequence opt5 from neuraminidase__InfluenzaA__ABK40736

SEQ ID NO: 198603 - RNA, 1410 nt, Artificial Sequence; identical to SEQ ID NO: 198469
  derived and/or modified sequence opt5 from neuraminidase__InfluenzaA__ABK40747

SEQ ID NO: 198604 - RNA, 1413 nt, Artificial Sequence; identical to SEQ ID NO: 197975
  derived and/or modified sequence opt5 from neuraminidase__InfluenzaA__ABK79951

SEQ ID NO: 198605 - RNA, 1413 nt, Artificial Sequence; identical to SEQ ID NO: 198580
  derived and/or modified sequence opt5 from neuraminidase__InfluenzaA__ABK79973

SEQ ID NO: 198606 - RNA, 1410 nt, Artificial Sequence; identical to SEQ ID NO: 197754
  derived and/or modified sequence opt5 from neuraminidase__InfluenzaA__ABK79984

SEQ ID NO: 198607 - RNA, 1410 nt, Artificial Sequence; identical to SEQ ID NO: 197754
  derived and/or modified sequence opt5 from neuraminidase__InfluenzaA__ABK79995

SEQ ID NO: 198608 - RNA, 1413 nt, Artificial Sequence; identical to SEQ ID NO: 198083
  derived and/or modified sequence opt5 from neuraminidase__InfluenzaA__ABK80028

SEQ ID NO: 198609 - RNA, 1413 nt, Artificial Sequence; identical to SEQ ID NO: 198083
  derived and/or modified sequence opt5 from neuraminidase__InfluenzaA__ABK80039

SEQ ID NO: 198610 - RNA, 1413 nt, Artificial Sequence; identical to SEQ ID NO: 198083
  derived and/or modified sequence opt5 from neuraminidase__InfluenzaA__ABK80050

SEQ ID NO: 198611 - RNA, 1410 nt, Artificial Sequence
  derived and/or modified sequence opt5 from neuraminidase__InfluenzaA__ABK80061
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagucucgcuccggauacgagacguuuaaagugauugaaggcuggagcaagccuaauucuaaacugcagaucaacagacaggucaucguggaccggggcaaucgcuccggguauagcggaauuuucuccgucgagggcaagucuugcaucaacagauguuuuuacguggaacugauucgggggagaaagcaggagacagaaguucucuggaccagcaauuccaucguggucuucugcggaaccucuggcacauaugggaccggcagcuggcccgauggagccgacauuaaccugaugccuaucuga

SEQ ID NO: 198612 - RNA, 1410 nt, Artificial Sequence; identical to SEQ ID NO: 197085
  derived and/or modified sequence opt5 from neuraminidase__InfluenzaA__ABK80072

SEQ ID NO: 198613 - RNA, 1410 nt, Artificial Sequence
  derived and/or modified sequence opt5 from neuraminidase__InfluenzaA__ABK80083
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugaugcugugcgaacccacaaucauugagagaaacaucaccgaaauuguguaucucacaaauaccacgaucgagaaggaaauuuguccuaaacuggccgaguaccggaacugguccaagccccagugcaauaucaccggguucgcgccuuuuucuaaagacaacagcauucgccuuuccgcuggaggcgauaucugggucacaagagagcccuaugugucuugugacccugauaagugcuaccaauucgcccuggggcagggaaccacacucaauaacggccauagcaaugacaccguucacgaucggacgccguaucgcacacugcugaugaacgaacucggggugcccuuucaucugggaaccaagcaggucuguaucgccugguccucuagcuccugccacgacggcaaagccuggcuucauguguguguuacaggcgaugacgagaaugcuaccgcuagcuucauuuacaacgggagacugguggauucuaucggauccuggagcaagaaaauucuccggacccaggaaucugagugcgucuguaucaauggcacaugcacgguggugaugaccgacggguccgccagcggaaaggcggauacaaaaauucuguuuaucgaggaaggcaagaucguccacaccucccuucugucugggagcgcccaacacguugaggaaugcuccuguuauccucgcuaccccggagugagaugcgugugucgggacaacuggaagggcagcaaccgcccuauugucgauaucaaugugaaagacuacucuauuguuuccagcuaugugugcucuggccucgucggggacacacccagaaagaacgauagcuccucuagcucccauugucuggacccgaauaacgaggaaggaggccacggggugaaaggaugggcuuucgaugacggcaaugauguuuggauggggcggaccaucagcgagaagcugcgcucuggauacgagacguuuaaagugauugaaggcugguccaagccuaacagcaaacuccagaucaauagacaggucaucguggaccggggcaaccgcucuggguauuccggaauuuucagcgucgagggcaaguccugcaucaauagauguuuuuacguggaacugauucgggggagaaagcaggagacagaaguucuuuggaccucuaacagcaucguggucuucugcggaaccuccggcacauaugggaccggcucuuggcccgauggagccgacauuaaucugaugccuaucuga

SEQ ID NO: 198614 - RNA, 1410 nt, Artificial Sequence
  derived and/or modified sequence opt5 from neuraminidase__InfluenzaA__ABK80094
augaaccccaaucagaagaucauuaccaucggcagcgugucccugauuaucgccacaauuugcuuccucaugcaaaucgcuauccuggucacgaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaacauuacgggguucgcgccuuuuuccaaagacaauucuauccgccuuagcgcuggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaaagcaggucuguauugccuggagcuccagcucuugccacgacggcaaagccuggcuucauguguguguuaccggcgaugacgagaacgcuacagcuuccuucaucuacaaugggagacugguggauagcauuggaucuugguccaagaaaauccuccggacccaggaaagcgagugcgucuguauuaacgggaccugcacaguggugaugacggacggcucugccuccggaaaggcggauaccaaaauccuguuuaucgaggaaggcaagauuguccacacaagcucccuuucugggagcgcccaacacguugaggaaugcuccuguuauccucgcuaccccggagugagaugcgugugucgggacaacuggaagggcagcaaucgcccuaucgucgauauuaacgugaaagacuacucuaucguuuccagcuaugugugcucuggccuggucggggacacccccagaaagaaugauagcuccucuagcucccauugucucgacccgaacaaugaggaaggaggccacggggugaaaggaugggcuuucgaugacggcaacgauguuuggauggggcggacaauuagcgagaagcugcgcucuggauacgagaccuuuaaagugaucgaaggcugguccaagccuaauagcaaacugcagaucaacagacaggucauuguggaccggggcaaucgcucuggguauuccggaaucuucagcgucgaguccaagucuugcauuaacagauguuuuuacguggaacucauccggggcagaaagcaggagacggaaguucuguggacaagcaauuccauuguggucuucugcgggaccucuggaaccuauggcacagggagcuggcccgauggcgccgacaucaaccuuaugccuauuuga

SEQ ID NO: 198615 - RNA, 1410 nt, Artificial Sequence; identical to SEQ ID NO: 197754
  derived and/or modified sequence opt5 from neuraminidase__InfluenzaA__ABK80105

SEQ ID NO: 198616 - RNA, 1410 nt, Artificial Sequence
  derived and/or modified sequence opt5 from neuraminidase__InfluenzaA__ABK80138
augaaccccaaucagaagaucauuaccaucggcagcgugucccugacaauugccacgaucugcuuccucaugcaaaccgcuauucuggucacaaccguuacacuucacuuuaaacaguacgaguguaacucuccuccgaauaaccaggugaugcugugcgaacccaccaucaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggcuuggcuucauguguguguuaccggcgaugacgagaacgccaccgcuuccuucaucuacaaugggcggcugguggauagcauuggaucuugguccaaaaagauccuccgcacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacauucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccugaugccuaucuga

SEQ ID NO: 198617 - RNA, 1410 nt, Artificial Sequence
  derived and/or modified sequence opt5 from neuraminidase__InfluenzaA__ABK80149
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggccaugcuguaugaacccacaaucauugagagaaauaucaccgaaauuguguaccucacaaacaccacgaucgagaaggaaauuugcccuaaacuggcggaguaucggaauuggagcaagccccaguguaacaucaccggguucgcuccuuuuuccaaagacaauucuauucgccuuagcgccggaggcgauaucugggugacaagagagcccuacgucuccugcgacccugauaaguguuaucaauucgcccuggggcagggaaccacacucaacaauggccauucuaacgacaccgugcacgaucggacgccguaccgcacacugcugaugaaugaacucgggguucccuuucaucugggaaccagacaggugugcaucgcuuggagcuccagcucuugucacgacggcaaggccuggcuucaugucugcgugacaggcgaugacgagaacgcuaccgccuccuucauuuauaaugggcggcugguugauagcaucggaucuugguccaaaaagauucuccgcacccaggaaagcgagugugugugcaucaacggcacauguacggucgugaugaccgacgggucugcguccggaaaagccgauacaaagauucuguuuaucgaggaaggcaaaaucgugcacauuagcacccuuuccgggucugcucaacacgucgaggaaugcagcugcuacccuagauaccccggaguucggugugugugccgcgacaacuggaagggcuccaauagaccuaucguggauauuaacgucaaggacuauagcaucgugucuuccuacguuuguagcggccuggugggggacacaccccggaaaaaugauucuuucagcuccucucauugccucgacccgaacaaugaggaaggaggccacggggucaagggaugggccuuugaugacggcaacgauguguggauggggcgcaccauuagcgagaaacugagauccggauaugagacguucaagguuaucgaaggcuggagcaaaccuaauucuaagcugcagaucaaccgccaggugauugucgagcggggcaauagauccggguacagcggaaucuuuucuguggaaggcaaauccuguauuaaccggugcuucuaugucgagcucaucagagggcgcaaggaagagacagaggugugguggaccagcaauuccauuguuguguuuuguggaaccucuggcacauacgggaccggcagcuggcccgacggagcugauaucaaccugaugccuauuuga

SEQ ID NO: 198618 - RNA, 1410 nt, Artificial Sequence; identical to SEQ ID NO: 198617
  derived and/or modified sequence opt5 from neuraminidase__InfluenzaA__ABK80160

SEQ ID NO: 198619 - RNA, 1410 nt, Artificial Sequence
  derived and/or modified sequence opt5 from neuraminidase__InfluenzaA__ABK80171
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgaucggacgcccuaucgcacacugcugaugaaugaacucggggugccuuuucaucugggaaccagacaggucuguaucgccuggucuagcuccagcugccacgacggcaaggcuuggcuucauguguguguuacaggcgaugacgagaacgccaccgcuucuuucauuuacaaugggcggcugguggauuccaucggaagcuggucuaaaaagauucuccgcacccaggaauccgagugcgucuguaucaacggcacaugcacgguggugaugaccgacgggagcgccucuggaaaagcggauacaaagauucuguuuaucgaggaaggcaaaaucguccacauuuccacccuuagcggguccgcccaacacguugaggaaugcucuuguuaucccagauacccuggagugcggugcgugugucgcgacaacuggaagggcagcaauagacccaucgucgauauuaacgugaaggacuacuccaucuucagcucuuauguuugcuccggccuggugggggacacaccgcggaaaaaugauagcuuuucuagcucccauugucucgacccuaacaaugaggaaggaggccacggggucaagggaugggcuuucgaugacggcaacgauguguggauggggcgcaccauuucugagaaacugagaagcggauacgagacguuuaagguuaucgaaggcugguccaaacccaauagcaagcugcagacaaaccgccaggugaucgucgagcggggcaauagaucuggguauuccggaauuuucagcguggaaggcaaaucuugcaucaaccgguguuuuuacgucgagcucauuagagggcgcaaggaagagaccgaggugugguggaccuccaauagcaucguuguguucugcggaacauccggcaccuaugggacaggcucuuggccugacggagccgauauuaaccugaugcccaucuga

SEQ ID NO: 198620 - RNA, 1410 nt, Artificial Sequence
  derived and/or modified sequence opt5 from neuraminidase__InfluenzaA__ABK80182
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacaaaaacgccaccgcuuccuucauuuacaaugggaagcugguggauagcaucggaucuugguccaaaaagauucuccggacccaggagagcgaaugcgucuguaucaacggcacaugcgccguggugaugacggacgggucugcguccggaaaagccgauaccaagauucuguuuaucgaggagggcaagaucguccacauuagcacacuuuccgggucugcucaacacguugaagagugcagcuguuauccucgcuaccccggagugagaugcgugugucgggacaacuggaaaggcuccaaucgcccuaucgucgauauuaacgugaaggacuacagcaucguuucuuccuaugugugcagcggccuggucggggacacccccagaaagaaugauucuuucagcuccucucauugucucgacccgaacaaugaagagggaggccacggggugaaaggaugggccuuugaugacggcaacgauguuuggauggggcggacaauuagcgaaaaacugcgcuccggauacgagaccuucaaggugaucgagggcuggagcaaaccuaauucuaagcugcagacgaacagacaggucaucguggaacggggcaaucgcuccggguauagcggaaucuuuucugucgagggcaaguccugcauuaacagauguuucuacguggaacucauucgggggagaaaagaggaaacagagguuugguggaccagcaauuccaucguggucuuuugcggaaccucuggcacauaugggaccggcagcuggcccgacggagcugauauuaaccugaugccuaucuga

SEQ ID NO: 198621 - RNA, 1410 nt, Artificial Sequence
  derived and/or modified sequence opt5 from neuraminidase__InfluenzaA__ABK80193
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaaugauucuuucagcuccucucauugucucgacccgaacaaugaggaaggaggccacggggugaagggaugggcuuuugaugacggcaacgauguuuggauggggcgcaccauuggagagaaacugagaagcggcuacgagacguucaaggugaucgaaggcugguccaaaccuaauagcaagcugcagacaaaccggcaggucaucguggagcgcgggaauagaucuggauauuccggcauuuuuagcgucgaagggaaaucuugcaucaaccgguguuucuacguggagcucauuagaggacgcaaggaagagaccgagguuugguggaccuccaauagcaucguggucuuuugcggcacauccgggaccuauggcacaggaucuuggcccgacggcgccgauauuaaccugaugccuaucuga

SEQ ID NO: 198622 - RNA, 1410 nt, Artificial Sequence
  derived and/or modified sequence opt5 from neuraminidase__InfluenzaA__ABK80204
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggaaacugguggauagcaucggaucuugguccaagaaaauucuccggacccaggaaagcgagugcgucuguaucaacggcacaugcgccguggugaugacggacgggucugcguccggaaaggccgauaccaaaauucuguuuaucgaggaaggcaagaucguccacauuagcacacuuuccgggucugcucaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccuggucggggacacccccagaaagaaugauucuuucagcuccucucauugucucgacccgaacaaugaggaaggaggccacggggugaaaggaugggccuuugaugacggcaacgaugcuuggauggggcggacaauuagcgagaagcugcgcuccggauacgagaccuucaaaguuaucgaaggcuggagcaagccuaauucuaaacugcagacgaacagacaggugaucgucgagcggggcaaucgcuccggguauagcggaaucuuuucuguggaaggcaaguccugcauuaacagauguuucuacgucgagcucauucgggggagaaaggaagagacagaggugugguggaccagcaauuccaucguuguguuuugcggaaccucuggcacauaugggaccggcagcuggcccgacggagccgauauuaaccugaugccuaucuga

SEQ ID NO: 198623 - RNA, 1410 nt, Artificial Sequence; identical to SEQ ID NO: 197615
  derived and/or modified sequence opt5 from neuraminidase__InfluenzaA__ABK80215

SEQ ID NO: 198624 - RNA, 1410 nt, Artificial Sequence; identical to SEQ ID NO: 197615
  derived and/or modified sequence opt5 from neuraminidase__InfluenzaA__ABK80226

SEQ ID NO: 198625 - RNA, 1410 nt, Artificial Sequence
  derived and/or modified sequence opt5 from neuraminidase__InfluenzaA__ABK80237
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugauaagugcuaucaauucgcucuggggcagggaaccacacucaacaauggccacucuaacgacaccgugcaugaucggacgccguaccgcacacugcugaugaaugaacucgggguccccuuucaccugggaaccagacagguguguaucgccuggagcuccagcucuugccaugacggcaaggccuggcuucacguuugugugacaggcgaugacaaaaacgcuaccgccuccuucauuuauaaugggcggcuggucgauagcaucggaucuugguccaagaaaauucuccgcacccaggagagcgaaugcguguguaucaacggcacaugcacgguggucaugaccgacgggucugcuuccggaaaggccgauacaaaaauucuguuuaucgaggagggcaagaucguucacauuagcacccuuuccgggucugcgcaacauguggaagagugcagcuguuacccuagauaucccggagugcggugcgucugucgcgacaacuggaagggcuccaauagaccuaucguggauauuaacguuaaagacuacagcaucgugucuuccuacgucugcagcggccuggugggggacacaccccggaagaccgauucuuucagcuccucucacugucucgacccgaauaacgaagagggaggccaugggguuaaaggaugggccuuugaugacggcaaugauguguggauggggcgcacgauuagcgaaaagcugagauccggauaugagacauucaaagucaucgagggcuggagcaagccuaacucuaaacugcagaucaaucgccaggugauugucgaacggggcaacagauccggguacagcggaaucuuuucuguggagggcaaguccugcauuaaucgguguuucuauguugaacucaucagagggcgcaaggaggaaaccgaggugugguggaccagcaacuccauugucguguuuugcggaacaucuggcaccuacgggacaggcagcuggcccgacggagcugauaucaaucugaugccuauuuga

SEQ ID NO: 198626 - RNA, 1410 nt, Artificial Sequence
  derived and/or modified sequence opt5 from neuraminidase__InfluenzaA__ABK80259
augaaccccaaucagaagaucauuaccaucggcagcgccucccugacaauugcuacgaucugcuuccucauucaaaucgccauccugguuaccacagucacccuucacuuuaaacagcaugaguguaacucuccuccgaauaaccagguuaugcugugcgaacccacaauuaucgagagaaauauuaccgaaaucguguaccucacaaacaccacgauugagaaggaaaucuguccuaaacuggcggaguaucggaauuggagcaagccccagugcaacauuaccggguucgcuccuuuuuccaaagacaauucuauccgccuuagcgccggaggcgauaucugggugacaagagagcccuacgucuccugugacccugauaagugcuaucaauucgcccuggggcagggaaccacacucaacaauggccacucuaacgacaccgugcaugaucggacgccguaccgcacacugcugaugaaugaacucgggguucccuuucaccugggaaccagacagguguguauugcuuggagcuccagcucuugccaugacggcaaggccuggcuucacgucugugugacaggcgaugacaaaaacgcuaccgccuccuucaucuauaaugggcggcugguugauagcauuucuuccuggagcaagaaaauccuccgcacccaggagucugaaugcguguguauuaacggaacaugcacggucgugaugaccgacggcuccgcgagcgggaaggccgauacaaaaauccuguuuaucgaggagggaaagauuauccacauuuccacccuuucuggcagcgcucaacauguggaagagugcuccuguuacccuagauaucccgggguccggugcguuugucgcgacaacuggaagggaagcaauagaccuaucguggauauuaacgugaaagacuacucuaucgucuccagcuacgugugcucuggccugguuggcgacacaccccggaagaaugauagcuucuccucuagccacugucucgacccgaacaaugaagaagggggacauggcgugaaagggugggccuuugaugacggaaacgaugucuggaugggccgcaccaucuccgagaagcugagaagcggguaugagacguucaaagugauugagggauggucuaauccuaacuccaagcugcagaucaaucggcagguuauuguggaacgcggcaacagaagcggcuacucugggaucuuuuccgucgagggaaaaagcugcauuaaucgguguuucuauguggaacucaucagaggccgcaaggaggaaacagaggucugguggaccuccaacucuauugugguguuuugcgggaccagcggaacauacggcaccggguccuggcccgacggcgcugauaucaaucugaugccuaucuga

SEQ ID NO: 198627 - RNA, 1410 nt, Artificial Sequence; identical to SEQ ID NO: 197351
  derived and/or modified sequence opt5 from neuraminidase__InfluenzaA__ABK80270

SEQ ID NO: 198628 - RNA, 1410 nt, Artificial Sequence; identical to SEQ ID NO: 197738
  derived and/or modified sequence opt5 from neuraminidase__InfluenzaA__ABK80281

SEQ ID NO: 198629 - RNA, 1410 nt, Artificial Sequence
  derived and/or modified sequence opt5 from neuraminidase__InfluenzaA__ABK80292
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuauccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuauugaagggugguccaauccuaacagcaagcugcagaucaauagacaggugauugucgaccggucuaaccgcuccggauauagcggcaucuucuccguggagggcaaaucuuguauuaauagaugcuuuuacgucgaacugauccgggggagaaaggaggaaaccgaggugcucuggaccagcaacuccauuguuguguucuguggaacaucuggcaccuaugggacaggaagcuggcccgauggcgcugacaucaaucugaugccuaucuga

SEQ ID NO: 198630 - RNA, 1410 nt, Artificial Sequence
  derived and/or modified sequence opt5 from neuraminidase__InfluenzaA__ABK80303
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcuguaugaacccacaaucauugagagaaauaucaccgaaauuguguaccucacaaacaccacgaucgagaaggaaauuugcccuaaacuggccgaguaucggaauuggagcaagccccaguguaacaucaccggguucgcgccuuuuuccaaagacaauucuauucgccuuagcgcuggaggcgauaucugggucacaagagagcccuacguguccugcgacccugauaaguguuaucaauucgcccuggggcagggaaccacacucaacaauggccauucuaacgacaccguucacgaucggacgccguaccgcacacugcugaugaaugaacucggggugcccuuucaucugggaaccagacaggucugcaucgccuggagcuccagcucuugucacgacggcaaggcuuggcuucaugugugcguuacaggcgaugacgagaacgccaccgcuuccuucauuuauaaugggcggcugguggauagcaucggaucuugguccaaaaagauucuccgcacccaggaaagcgagugugucugcaucaacggcacauguacgguggugaugaccgacgggaacgccucuggaaaagcggauacaaagauucuguuuaucgaggaaggcaaaaucguccacauuuccacccuuagcggguccgcccaacacguugaggaaugcucuugcuacccuagauaccccggagugcggugugugugccgcgacaauuggaagggcagcaacagaccuaucgucgauauuaaugugaaggacuauuccaucguuagcucuuacguguguuccggccuggucggggacacaccccggaaaaacgauagcuucucuagcucccauugccucgacccgaauaacgaggaaggaggccacggggugaagggaugggcuuuugaugacggcaaugauguuuggauggggcgcaccauuucugagaaacugagaagcggauaugagacguucaaggugaucgaaggcugguccaaaccuaacagcaagcugcagaucaaucggcaggucauuguggagcgcggcaacagaucuggguacuccggaaucuuuagcgucgaaggcaaaucuuguauuaaucggugcuucuauguggagcucaucagagggcgcaaggaagagacagagguuugguggaccuccaacagcauuguggucuuuuguggaaccuccggcacauacgggaccggcucuuggcccgacggagccgauaucaaucugaugccuauuuga

SEQ ID NO: 198631 - RNA, 1410 nt, Artificial Sequence
  derived and/or modified sequence opt5 from neuraminidase__InfluenzaA__ABK80314
augaaccccaaucagaagaucauuaccaucggcagcgugucccugacaauugccacgaucugcuuccucaugcaaauugcuauccuggucaccacaguuacccuucacuuuaaacaguacgagugugacucuccuccgaacaaucaggugaugcuguaugaacccacaaucauugagagaaacaucaccgaaauuguguaccucacaaauaccacgaucgagaaggaaauuugcccuaaacuggccgaguaucggaacuggagcaagccccaguguaauaucaccggguucgcgccuuuuuccaaagauaacucuauucgccuuagcgcuggaggcgacaucugggucacaagagagcccuacguguccugcgauccugacaaguguuaucaauucgcccuggggcagggaaccacacucaauaacggccauucuaaugauaccguucacgaccggacgccguaccgcacacugcugaugaacgaacucggggugcccuuucaucugggaaccagacaggucugcaucgccuggagcuccagcucuugucacgauggcaaggcuuggcuucaugugugcguuacaggcgacgaugagaaugccaccgcuuccuucauuuauaacgggcggcugguggacagcaucggaucuugguccaaaaagauucuccgcacccaggaaagcgagugugucugcaucaauggcacauguacgguggugaugaccgaugggucugccuccggaaaagcggacacaaagauucuguuuaucgaggaaggcaaaaucguccacauuagcacccuuuccgggucugcccaacacguugaggaaugcagcugcuacccuagauaccccggagugcggugugugugccgcgauaacuggaagggcuccaacagaccuaucgucgacauuaaugugaaggacuauagcaucguuucuuccuacguguguagcggccuggucggggauacaccccggaaaaacgacucuuucagcuccucucauugccucgauccgaauaacgaggaaggaggccacggggugaagggaugggcuuuugacgauggcaaugacguuuggauggggcgcaccauuagcgagaaacugagauccggauaugagacguucaaggugaucgaaggcuggagcaaaccuaacucuaagcugcagaucaaucggcaggucauuguggagcgcggcaacagauccggguacagcggaaucuuuucugucgaaggcaaauccuguauuaaucggugcuucuauguggagcucaucagagggcgcaaggaagagacagagguuugguggaccagcaacuccauuguggucuuuuguggaaccucuggcacauacgggaccggcagcuggcccgauggagccgacaucaaucugaugccuauuuga

SEQ ID NO: 198632 - RNA, 1350 nt, Artificial Sequence
  derived and/or modified sequence opt5 from neuraminidase__InfluenzaA__ABL07021
augaaccccaaucagaagaucauuaccaucggcagcauuugcauggugaucgggauugucucccugaugcuccaaaucggaaacaugaucucuauuuggguuagccacuccauccagaaaggcaaucagcaucaggccgagucuauuagcaacacaaauccucugacggaaaaggcuguggccuccaucacccuugcggggaacucuagccuguguccgauuagaggaugggcugugcacuccaaagacaauaacauccggauuggcagcaagggggaugucuucgugauccgcgagcccuuuaucucuugcucccaucucgaauguagaacauucuuucugacccaaggagcccuucugaaugacaaacacagcaacggcacaguuaaggaucggucuccucaucgcacccucauguccugccccgugggcgaggccccuagccccuacaauucuagauucgaauccgucgcuuggagcgccuccgcuugucacgacgggacaucuuggcugaccauuggaaucagcggcccugauaacgaggccguggcgguucugaaguauaaugggauuaucacggacaccauuaaauccuggcggaacaauauccuccgcacacaggagagcgaaugcgccugugugaacggaucuugcuuuaccgucaugacagauggcccguccaacgggcaggcuagcuacaagaucuucaaaaugaagaaaggaaagguggugaagucugucgagcuggacgcccccaauuaucacuacgaagaguguagcugcuauccugaugcuggcgagauuaccuguguuugcagagacaacuggcauggcuccaaucggcccugggugucuuuuaaccagaaucuugaauaccaaaucggguauauuugcagcggaguguucggcgauaacccucgccccaaugacgggacgggauccuguggcccgaugagcccuaacggggccuacggagucaaaggcuuuucuuucaaguacggcaaugggguguggaucggaagaacaaaauccaccaacagccggucuggcuuugagaugauuugggaucccaauggguggacaggaaccgacuccagcuucuccguuaagcaggacaucguggcgaucaccgauuggucuggcuauagcggguccuuuguccagcacccugaacugacaggccucgacugcauucgccccuguuucuggguggagcugaucagaggacggcccaaagaaucuacgauuuggaccagcggcuccagcaucucuuucugcgggguuaacuccgauacagugagcuggucuuggccugacggagccgagcuuccguuuaccauugauaaguga

SEQ ID NO: 198633 - RNA, 1350 nt, Artificial Sequence
  derived and/or modified sequence opt5 from neuraminidase__InfluenzaA__ABL07032
augaaccccaaucagaagaucauuaccaucggcagcauuugcauggugaucgggauugucucccugaugcuccaaaucggaaacaugguuucuacaugggugagccacuccauccagacgggcaaucaguaccaggccgagucuauuagcaacaccaauccucugacagaaaaagcuguggccuccgucacccuugcggggaacucuagccuguguccgaucagaggaugggcugugcauuccaaggacaauaacauucggaucggcagcaaaggggauguuuucgugauucgcgagcccuuuaucucuugcucccaccucgaauguagaacauucuuucugacccaaggagcccuucugaaugacaagcauagcaacggcacagucaaagaucggucuccucaccgcacccucauguccugccccgugggcgaggccccuagccccuauaauucuagauucgaauccguugcuuggagcgccuccgcuugucaugacgggacgucuuggcugaccauuggaaucagcggcccugauaacgaggccguggcgguccugaaguacaaugggaucauuacagacaccaucaaguccuggcggaacaauauucuccgcacacaggagagcgaaugcgccugugugaacggaucuugcuuuaccgugaugacggauggcccguccaacgggcaggcuagcuauaaaaucuucaagauggagaaaggaaaggucguuaaaucuguggaacuggacgcccccaauuaccacuaugaggaguguagcugcuacccugaugcuggcgaaauuacaugugugugcagagacaacuggcacggcuccaaucggcccugggucucuuuuaaccagaaucuugaguaucaaaucggguacaucugcagcggaguguucggcgauaacccucgccccaaugacgggaccggauccuguggcccgaugagcccuaacggggccuacggaguuaagggcuuuucuuucaaguauggcaaugggguguggauuggaagaacaaaauccaccaacagccggucuggcuuugaaaugaucugggaucccaauggguggaccggaacagacuccagcuucuccgucaagcaggacauuguggcgaucacggauuggucuggcuacagcggguccuuuguucagcauccugagcugaccggccucgacugcauucgccccuguuucuggguggaacugaucagaggacggcccaaagagucuacaaucuggaccagcggcuccagcauuucuuucugcggggucaacuccgauacagugagcuggucuuggccugacggagccgagcuuccguuuaccaucgauaaguga

SEQ ID NO: 198634 - RNA, 1350 nt, Artificial Sequence
  derived and/or modified sequence opt5 from neuraminidase__InfluenzaA__ABL31746
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaacucuuggcugaccaucggaauuagcggcccugauaaugaggccguugcggugcugaaguauaacgggaucauuacggacaccaucaaguccuggcggaaaaauauucuccgcacacaggagagcgaaugcgccugugucaacggaucuugcuuuaccgugaugacagauggcccguccaacgggcaggcuagcuacaagaucuucaaaauggagaagggaaaaguggucaagucuguugaacuggacgcccccaauuaucacuacgaggaguguagcugcuauccugaugcuggcgaaaucaccugugugugcagagacaacuggcauggcuccaaucggcccugggugucuuuuaaccagaaucuugaguaccaaauuggguauaucugcagcggagucuucggcgauaacccucgccccaaugacgggacgggauccuguggcccgaugagcccuaacggggccuacggagugaagggcuuuucuuucaaauacggcaaugggguuuggauuggaagaacaaaguccaccaacagccggucuggcuuugaaaugaucugggaucccaauggguggacaggaaccgacuccagcuucuccgugaaacaggacauugucgcgaucaccgauuggucuggcuauagcggguccuuugugcagcacccugagcugacaggccucgacugcauccgccccuguuucuggguugaacugauuagaggacggcccaaggagucuacgaucuggaccagcggcuccagcauuucuuucugcggggugaacuccgauacagucagcuggucuuggccugacggagccgagcuuccguuuaccaucgauaaauga

SEQ ID NO: 198635 - RNA, 1350 nt, Artificial Sequence
  derived and/or modified sequence opt5 from neuraminidase__InfluenzaA__ABL31757
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcuguggccuccgugacacuugcggggaacucuagccuguguccgaucagaggaugggcuguccacuccaaggacaauaacauucggaucggcagcaaaggggauguguucguuauucgcgagcccuuuaucucuugcucccaucucgaauguagaaccuucuuucugacacaaggagcccuucugaaugacaagcacagcaacggcaccgugaaagaucggucuccucaucgcacacucauguccugccccgucggcgaggccccuagccccuacaauucuagauucgaauccguggcuuggagcgccuccgcuugucacgacgggaccucuuggcugacgaucggaauuagcggcccugauaacgaggccguugcggugcugaaguauaaugggaucauuaccgacacaaucaaguccuggcggaacaauauucuccgcacccaggagagcgaaugcgccugugucaacggaucuugcuuuacagugaugaccgauggcccguccaacgggcaggcuagcuacaaaaucuucaagauggagaaaggaaagguggucaaaucuguugaacuggacgcccccaauuaucacuacgaggaguguagcugcuauccugaugcuggcgaaaucacgugugugugcagagacaacuggcauggcuccaaucggcccugggugucuuuuaaccagaaucuugaguaccaaauuggguauaucugcagcggagucuucggcgauaacccucgccccaaugacgggacaggauccuguggcccgaugagcccuaacggggccuacggagugaagggcuuuucuuucaaguacggcaaugggguuuggauuggaagaaccaaauccacaaacagccggucuggcuuugaaaugaucugggaucccaauggguggaccggaaccgacuccagcuucuccgugaagcaggacauugucgcgaucacagauuggucuggcuauagcggguccuuugugcagcacccugagcugacgggccucgacugcauccgccccuguuucuggguugaacugauuagaggacggcccaaagagucuaccaucuggacaagcggcuccagcauuucuuucugcggggugaacuccgauaccgucagcuggucuuggccugacggagccgagcuuccguuuacaaucgauaaguga

SEQ ID NO: 198636 - RNA, 1350 nt, Artificial Sequence; identical to SEQ ID NO: 198635
  derived and/or modified sequence opt5 from neuraminidase__InfluenzaA__ABL31768

SEQ ID NO: 198637 - RNA, 1410 nt, Artificial Sequence; identical to SEQ ID NO: 197615
  derived and/or modified sequence opt5 from neuraminidase__InfluenzaA__ABL67168

SEQ ID NO: 198638 - RNA, 1410 nt, Artificial Sequence; identical to SEQ ID NO: 197754
  derived and/or modified sequence opt5 from neuraminidase__InfluenzaA__ABL67179

SEQ ID NO: 198639 - RNA, 1413 nt, Artificial Sequence; identical to SEQ ID NO: 198580
  derived and/or modified sequence opt5 from neuraminidase__InfluenzaA__ABL67190

SEQ ID NO: 198640 - RNA, 1410 nt, Artificial Sequence
  derived and/or modified sequence opt5 from neuraminidase__InfluenzaA__ABL67201
augaaccccaaucagaagaucauuaccaucagcuccgugucucugacaauuagcacgaucugcuucuuuaugcaaauugccauccucaucaccacagucacccugcacuucaaacaguacgaguuuaacuccccuccgaauaaccagguuaugcuuugugaacccacaauuaucgagagaaauauuaccgaaaucguguaucugacaaacaccacgauugagaaggaaaucugcccuaaacucgcugaguaccggaauuggucuaagccccagugugacauuaccggcuucgccccuuuuagcaaagauaacuccauccgccugucugcugggggagacaucugggugacaagagagcccuaugucagcugcgauccugacaaguguuaccaauucgcgcuuggccaggggaccacacugaauaacgugcauuccaaugauaccguucacgaccggacgccguaucgcacacuccugaugaacgaacugggagugcccuuucaucucggcaccaagcaggucugcauugccuggucuagcuccagcugucacgaugggaaagccuggcugcaugugugcguuacaggagacgauaagaaugcuaccgccucuuucaucuacaacggcagacuuguggacuccauugucagcuggucuaaaaagauccugcggacccaggaguccgaaugugugugcauuaauggcacauguacgguggucaugaccgaugggagcgcuuccggaaaagccgacacaaagauccucuuuaucgaggagggcaagauuguucacaccucuacacugagcggguccgcgcaacacguggaagagugcagcugcuauccucgcuaccccggagugagaugugucugccgggauaacuggaaaggcucuaaccgcccuaucguggacauuaauaucaaggacuacuccauuguuagcucuuauguguguagcgggcuugucggagauacccccagaaagaacgacuccucuagcuccagccauugccuggauccgaauaacgaagagggcggccacggggugaaaggaugggccuucgacgauggcaaugacguuuggauggggcggacgaucucugaaaaacuccgcuccggauacgagacauuuaaggugaucgagggcuggagcaacccuaauucuaaacugcagauuaacagacaggucaucguggaucgggggaaucgcuccggauauagcggcauuuucuccgucgaaggcaagucuuguaucaacagaugcuuuuacguggagcugauucgggggagaaaggaagagaccgaaguucucuggaccagcaauuccaucguggucuucuguggaacaucuggcaccuaugggacaggaagcuggcccgacggcgcugauauuaaccugaugccuaucuga

SEQ ID NO: 198641 - RNA, 1413 nt, Artificial Sequence; identical to SEQ ID NO: 198580
  derived and/or modified sequence opt5 from neuraminidase__InfluenzaA__ABL67212

SEQ ID NO: 198642 - RNA, 1413 nt, Artificial Sequence; identical to SEQ ID NO: 198083
  derived and/or modified sequence opt5 from neuraminidase__InfluenzaA__ABL67256

SEQ ID NO: 198643 - RNA, 1413 nt, Artificial Sequence; identical to SEQ ID NO: 198083
  derived and/or modified sequence opt5 from neuraminidase__InfluenzaA__ABL67267

SEQ ID NO: 198644 - RNA, 1410 nt, Artificial Sequence; identical to SEQ ID NO: 197085
  derived and/or modified sequence opt5 from neuraminidase__InfluenzaA__ABL67278

SEQ ID NO: 198645 - RNA, 1410 nt, Artificial Sequence
  derived and/or modified sequence opt5 from neuraminidase__InfluenzaA__ABL67289
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcuguaugaacccacaaucauugagagaaauaucaccgaaauuguguaccucacaaacaccacgaucgagaaggaaauuugcccuaaacuggccgaguaucggaauuggagcaagccccaguguaacaucaccggguucgcgccuuuuuccaaagacaauucuauucgccuuagcgcuggaggcgauaucugggucacaagagagcccuacguguccugcgacccugauaaguguuaucaauucgcccuggggcagggaaccacacucaacaauggccauucuaacgacaccguucacgaucggacgccguaccgcacacugcugaugaaugaacucggggugcccuuucaucugggaaccagacaggucugcaucgccuggagcuccagcucuugucacgacggcaaggcuuggcuucaugugugcguuacaggcgaugacgagaacgccaccgcuuccuucauuuauaaugggcggcugguggauagcaucggaucuugguccaaaaagauucuccgcacccaggaaagcgagugugucugcaucaacggcacauguacgguggugaugaccgacgggucugccuccggaaaagcggauacaaagauucuguuuaucgaggaaggcaaaaucguccacauuagcacccuuuccgggucugcccaacacguugaggaaugcagcugcuacccuagauaccccggagugcggugugugugccgcgacaacuggaagggcuccaauagaccuaucgucgauauuaacgugaaggacuauagcaucguuucuuccuacguguguagcggccuggucggggacacaccccggaaaaaugauucuuucagcuccucucauugccucgacccgaacaaugaggaaggaggccacggggugaagggaugggcuuuugaugacggcaacgauguuuggauggggcgcaccauuagcgagaaacugagauccggauaugagacguucaaggugaucgaaggcuggagcaaaccuaauucuaagcugcagaucaaccggcaggucauuguggagcgcggcaauagauccggguacagcggaaucuuuucugucgaaggcaaauccuguauuaaccggugcuucuauguggagcucaucagagggcgcaaggaagagacagagguuugguggaccagcaauuccauuguggucuuuuguggaaccucuggcacauacgggaccggcagcuggcccgacggagccgauaucaaccugaugccuauuuga

SEQ ID NO: 198646 - RNA, 1410 nt, Artificial Sequence
  derived and/or modified sequence opt5 from neuraminidase__InfluenzaA__ABL67300
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaacauucuccgcacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccuagauaccccggagugcggugcgugugucgcgacaauuggaaaggcuccaacagaccuaucgucgauauuaaugugaaggaccauagcaucguuucuuccuacgugugcagcggccuggucggggacacaccccggaagaacgauucuuucagcuccucucacugucucgacccgaauaacgaggaaggaggccauggggugaaaggaugggcuuuugaugacggcaaugauguuuggauggggcgcaccauuagcgagaagcugagauccggauaugagacguucaaagugaucgaaggcuggagcaagccuaacucuaaacugcagaucaaucggcaggucauuguggagcgcggcaacagauccggguacagcggaaucuuuucugucgaaggcaaguccugcauuaaucgguguuucuauguggagcucaucagagggcgcaaagaagagacagagguuugguggaccagcaacuccauuguggucuuuugcggaaccucuggcacauacgggaccggcagcuggcccgacggagccgauaucaaucugaugccuauuuga

SEQ ID NO: 198647 - RNA, 1410 nt, Artificial Sequence; identical to SEQ ID NO: 197204
  derived and/or modified sequence opt5 from neuraminidase__InfluenzaA__ABL67311

SEQ ID NO: 198648 - RNA, 1410 nt, Artificial Sequence
  derived and/or modified sequence opt5 from neuraminidase__InfluenzaA__ABL67322
augaaccccaaucagaagaucauuaccaucggcagcgugucccugacaauugccacgaucugcuuccucaugcaaauugcuauccuggucaccacaguuacccuucacuuuaaacaguacgaguguaacccuccgcccaauaaccaggugaugcugugcgaaccuacaaucauugagagaaauaucaccgaaauuguguaucucacaaacaccacgaucgagaaggaaauuugucccaaacuggccgaguaccggaauuggucuaagccucagugcaacaucaccggguucgcgcccuuuagcaaagacaauuccauucgccuuucugcuggaggcgauaucugggucacaagagagccuuaugugagcugugacccggauaagugcuaccaauucgcccuggggcagggaaccacacucaacaauggccauuccaacgacaccguucacgaucggacgcccuaucgcacacugcugaugaaugaacucggggugccuuuucaucugggaaccagacaggucuguaucgccuggucuagcuccagcugccacgacggcaaggcuuggcuucauguguguguuacaggcgaugacgagaacgccaccgcuucuuucauuuacaaugggcggcugguggauuccaucggaagcuggucuaaaaagauucuccgcacccaggaauccgagugcgucuguaucaacggcacaugcacgguggugaugaccgacgggagcgccucuggaaaagcggauacaaagauucuguuuaucgaggaaggcaaaaucguccacaccuccacacuuagcggguccgcccaacacguugaggaaugcucuuguuaucccagauacccuggagugcggugcgugugucgcgacaacuggaagggcagcaauagacccauugucgauaucaacgugaaggacuacuccauuguuagcucuuaugugugcuccggccuggucggggacaccccgcggaaaaaugauagcuucucuagcucccauugucucgacccuaacaaugaggaaggaggccacggggugaagggaugggcuuuugaugacggcaacgauguuuggauggggcgcacgaucucugagaaacugagaagcggauacgagacauucaaggugauugaaggcugguccaaacccaauagcaagcugcagaccaaccggcaggucaucguggagcgcggcaauagaucuggguauuccggaaucuuuagcgucgaaggcaaaucuugcauuaaccgguguuucuacguggagcucaucagagggcgcaaggaagagaccgagguuugguggacauccaauagcauuguggucuuuugcggaaccuccggcacauaugggacgggcucuuggccugacggagccgauaucaaccugaugcccauuuga

SEQ ID NO: 198649 - RNA, 1410 nt, Artificial Sequence
  derived and/or modified sequence opt5 from neuraminidase__InfluenzaA__ABL67333
augaaccccaaucagaagaucauuaccaucggcagcgugucccugacaauugccacgaucugcuuccucaugcaaauugcuauccuggucaucaccguuacacuucacuuuaaacaguacgaguguaacucuccuccgaauaaccaggugaugcugugcgaacccaccauuaucgagagaaauauuacagaaaucguguaucucaccaacacaaccauugagaaggaaaucuguccuaaacuggccgaguaccggaauuggagcaagccccagugcaacauuacgggguucgcgccuuuuuccaaagacaauucuauccgccuuagcgcuggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguauugccuggagcuccagcucuugccacgacggcaaggcuuggcuucauguguguguuaccggcgaugacgagaacgccacagcuuccuucaucuacaaugggaaacugguggauagcauuggaucuugguccaagaaaauccuccggacccaggaaagcgagugcgucuguauuaacgggaccugcgccguggugaugacagacggcucugcguccggaaaggccgauacgaaaauccuguuuaucgaggaaggcaagauuguccacaucagcacccuuuccgggucugcucaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccuggucggggacacacccagaaagaaugauucuuucagcuccucucauugucucgacccgaacaaugaggaaggaggccacggggugaaaggaugggccuuugaugacggcaacgauguuuggauggggcggaccaucagcgagaagcugcgcuccggauacgagacauucaaagugaucgaaggcuggagcaagccuaauucuaaacugcagaccaacagacaggucauuguggagcggggcaaucgcuccggguauagcggaaucuuuucugucgaaggcaaguccugcauuaacagauguuucuacguggagcucauccgggggagaaaggaagagacggagguuugguggacaagcaauuccauuguggucuuuugcggaaccucuggcaccuaugggacaggcagcuggcccgacggagcugauaucaaccugaugccuauuuga

SEQ ID NO: 198650 - RNA, 1410 nt, Artificial Sequence; identical to SEQ ID NO: 197615
  derived and/or modified sequence opt5 from neuraminidase__InfluenzaA__ABL67344

SEQ ID NO: 198651 - RNA, 1410 nt, Artificial Sequence
  derived and/or modified sequence opt5 from neuraminidase__InfluenzaA__ABL67355
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggucgaguaucggaauuggagcaagccccagugcaacaucaccggguucgccccuuuuuccaaagacaauucuauucgccuuagcgcgggaggcgauaucugggugacaagagagcccuacguuuccugugacccugaaaagugcuaucaauucgcucuggggcagggaaccacacucaacaauggccacucuaacgauaccgugcaugaccggacgccguaccgcacacugcugaugaaugagcucgggguccccuuucaccugggaaccaaacagguguguaucgccuggagcuccagcucuugccaugauggcaaagccuggcuucacguuugugugacaggcgacgauaagaacgcuaccgccuccuucauuuauaaugggagacuggucgacagcaucggaucuugguccaaaaagauucuccggacccaggaaagcgagugcguguguaucaacggcacaugcacgguggucaugaccgaugggucugcuuccggaaaagccgacacaaagauucuguuuaucgaggaaggcaagaucguucacauuagcacccuuuccgggucugcgcaacauguggaggaaugcagcuguuacccucgcuaucccggagugagaugcgucugucgggauaacuggaaaggcuccaaucgcccuaucguggacauuaacguuaaggauuacagcaucgugucuuccuacgucugcagcggccuggugggggacacacccagaaagaaugacucuuucagcuccucucacugucucgauccgaacaaugaggaaggaggccaugggguuaagggaugggccuuugacgauggcaacgacguguggauggggcggaccauuagcgagaaacugcgcuccggauaugagacguucaaggucaucgaaggcuggagcaaaccuaauucuaagcugcagaucaacagacaggugauugucgagcggggcaaucgcuccggguacagcggaaucuuuucuguggaaggcaaguccugcauuaacagauguuucuauguugagcucauccgggggagaaaagaagagacagaggugugguggaccagcaauuccauugucguguuuugcggaaccucuggcacauacgggaccggcagcuggcccgauggagcugacaucaaccugaugccuauuuga

SEQ ID NO: 198652 - RNA, 1410 nt, Artificial Sequence
  derived and/or modified sequence opt5 from neuraminidase__InfluenzaA__ABL67366
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacacggauucuguuuaucgaggagggcaaaaucguccacauuagcacccuuuccgggucugcccaacauguugaagagugcagcuguuacccuagauaucccggagugcgcugcguguguagagacaacuggaagggcuccaaucggccuaucgucgauauuaacgugaaggacuacagcaucguuucuuccuacgugugcagcggccuggucggggacacaccccgcaaaaaugauucuuucagcuccucucacugucucgacccgaacaaugaagagggaggccauggggugaagggaugggcuuuugaugacggcaacgauguuuggauggggagaaccauuagcgaaaaacugcgguccggauaugagacguucaaggugaucgagggcuggagcaaaccuaauucuaagcugcagaucaaccgccaggucauuguggaaagaggcaaucgguccggguacagcggaaucuuuucugucgagggcaaauccugcauuaacagauguuucuauguggaacucauccgcgggcggaaggaggaaacagagguuugguggaccagcaauuccauuguggucuuuugcggaaccucuggcacauacgggaccggcagcuggcccgacggagccgauaucaaccugaugccuauuuga

SEQ ID NO: 198653 - RNA, 1410 nt, Artificial Sequence
  derived and/or modified sequence opt5 from neuraminidase__InfluenzaA__ABL67377
augaaccccaaucagaagaucauuaccaucggcagcgccucccugacaauugcuaucauuugcuuccucauccaaaucgccauucugguuacgaccgucacacuucacuuuaaacagcaugaguguaacucuccuccgaauaaccagguuaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauccgccuuagcgccggaggcgauauuugggugaccagagagcccuacgucuccugugacccugauaagugcuaucaauucgcccuggggcagggaacaacccucaacaauggccacucuaacgacacagugcaugaucggaccccguaccgcacgcugcugaugaaugaacucgggguucccuuucaccugggaacaagacagguguguaucgcuuggagcuccagcucuugccaugacggcaaggccuggcuucacgucugugugaccggcgaugacaaaaacgcuacagccuccuucauuuauaaugggcggcugguugauagcaucucuuccuggagcaagaaaauucuccgcacccaggagucugaaugcguguguaucaacggaaccugcacagucgugaugacggacggcuccgcgagcgggaaggccgauaccaaaauccuguuuauugaggagggaaagaucauucacaucuccacacuuucuggcagcgcucaacauguggaagagugcuccuguuacccuagauaucccgggguccggugcguuugucgcgacaacuggaagggaagcaauagaccuauuguggauaucaacgugaaagacuacucuaucgucuccagcuacgugugcucuggccugguuggcgacacaccccggaagaaugauagcuucuccucuagccacugucucgacccgaacaaugaagaagggggacauggcgugaaagggugggccuuugaugacggaaacgaugucuggaugggccgcaccauuuccgagaagcugagaagcggguaugagaccuucaaagugaucgagggauggucuaauccuaacuccaagcugcagauuaaucggcagguuaucguggaacgcggcaacagaagcggcuacucugggaucuuuuccgucgagggaaaaagcugcauuaaucgguguuucuauguggaacucauuagaggccgcaaggaggaaacggaggucugguggacauccaacucuaucgugguguuuugcgggaccagcggaaccuacggcacaggguccuggcccgacggcgcugaucugaaucuuaugccuaucuga

SEQ ID NO: 198654 - RNA, 1410 nt, Artificial Sequence; identical to SEQ ID NO: 197351
  derived and/or modified sequence opt5 from neuraminidase__InfluenzaA__ABL67388

SEQ ID NO: 198655 - RNA, 1410 nt, Artificial Sequence; identical to SEQ ID NO: 197351
  derived and/or modified sequence opt5 from neuraminidase__InfluenzaA__ABL67399

SEQ ID NO: 198656 - RNA, 1410 nt, Artificial Sequence; identical to SEQ ID NO: 197736
  derived and/or modified sequence opt5 from neuraminidase__InfluenzaA__ABL67410

SEQ ID NO: 198657 - RNA, 1410 nt, Artificial Sequence
  derived and/or modified sequence opt5 from neuraminidase__InfluenzaA__ABL67421
augaaccccaaucagaagaucauuaccaucggcagcauuucccugacaaucucuacgauuugcuucuuuaugcaaaucgccauccucauuaccacagugacccugcacuucaaacaguacgaguuuaacagcccuccgaauaaccaggucaugcuuugugaacccacaaucauugagagaaauaucaccgaaauuguuuaucugacaaacaccacgaucgagaaggaaauuugcccuaaacucgcugaguaccggaauugguccaagccccaguguaacaucaccggguucgccccuuuuucuaaagacaauagcauccgccuguccgcgggaggcgauauuugggugacaagagagcccuaugugucuugcgacccugauaaguguuaccaauucgcucuugggcagggaaccacacugaacaauguccauagcaacgacaccgugcacgaucggacgccguaucgcacacuccugaugaaugaacugggcguucccuuucaucucgggaccaaacaggugugcaucgccugguccucuagcuccugucacgacggaaaggccuggcugcaugucugcgugacaggcgaugacaagaacgcuaccgccagcuucauuuacaauggcagacuuguugauucuaucguguccuggagcaaagagauucugcggacccaggaaucugagugugucugcaucaacgggacauguacgguggugaugaccgacggauccgcuagcggcaaggccgauacaaaaauccucuuuauugaggaagggaagaucguccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuauugaagggugguccaauccuaacagcaagcugcagaucaauagacaggugauugucgaccggggaaaccgcucuggcuauuccggcaucuucagcguggaggggaaauccuguauuaauagaugcuuuuacgucgaacugauccggggaagaaaggaggaaaccgaggugcucuggaccucuaacagcauuguuguguucuguggcacauccgggaccuauggaacaggcucuuggcccgauggggcugacaucaaucugaugccuaucuga

SEQ ID NO: 198658 - RNA, 1350 nt, Artificial Sequence
  derived and/or modified sequence opt5 from neuraminidase__InfluenzaA__ABL67772
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaucuggaaugucgcaccuuuuuccuuacacagggagcccugcucaaugacaagcacagcaacggcaccgugaaagauagaucuccucaucggacacugauguccugccccgucggcgaggccccuagccccuauaauucucgcuuugaauccguggcuuggagcgccuccgcuugucacgacgggaccucuuggcugacgauuggaaucagcggcccugauaacggggccguugcggugcucaaguacaauggaaucauuaccgacacaaucaaauccuggagaaacaauauucugcggacccaggagagcgagugcgccugugucaacggcucuugcuucacagugaugaccgaugggccguccaacggacaggcuagccacaagaucuuuaaaauggaaaagggcaagguggucaaaucuguugagcuugacgcccccaauuaucauuacgaagaguguagcugcuauccugaugcuggcgagauuacgugugugugccgcgacaacuggcacggguccaauagacccugggugucuuucaaccaaaaucugaaguaccagaucggauauaucugcagcggcgucuuuggggauaacccucggcccaaugacggaacaggcuccugugggccggugagcucuaacggagccuacggcguuaaaggcuucuccuuuaaguacgggaauggaguguggauuggccgcaccaaaagcacaaacucuagauccggguucgaaaugaucugggauccuaauggauggaccgagaccgacagcuccuuuucugucaagcaggacauuguggcgaucacagauuggagcggcuauuccgggucuuucguucagcaucccgaacucacgggccuggacugcauucggccuuguuucuggguggagcuuauccgcggaagacccaaagaaagcaccaucuggacauccggcagcucuauuuccuuuugcggggucaacagcgauaccgugggauggucuuggcccgacggcgccgagcugccuuucacaaucgauaaguga

SEQ ID NO: 198659 - RNA, 1350 nt, Artificial Sequence
  derived and/or modified sequence opt5 from neuraminidase__InfluenzaA__ABL67783
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaucuggaaugucgcaccuuuuuccuuacacagggagcccugcucaaugacaagcacagcaacggcaccgugaaagauagaucuccucaucggacacugauguccugccccgucggcgaggccccuagccccuauaauucucgcuuugaauccguggcuuggagcgccuccgcuugucacgacgggaccucuuggcugacgauuggaaucagcggcccugauuccggggccguugcggugcucaaguacaacggaaucauuaccgacacaaucaaaagcuggagaaauaacauucugcggacccaggagucugagugcgccugugucaauggcuccugcuucacagugaugaccgaugggccgagcaacggacaggcuucucacaagaucuuuaaaauggaaaagggcaagguggucaaaagcguugagcuugacgcccccaacuaucauuacgaagaguguuccugcuauccugaugcuggcgagauuacgugugugugccgcgacaauuggcacgggucuaacagacccugggugagcuucaaucaaaaccuggaauaccagaucggauauaucugcuccggcgucuuuggggauaauccucggcccaacgacggaacaggcagcugugggccggugucuuccaauggagccuacggcguuaagggcuucagcuuuaaauacgggaacggaguguggauuggccgcaccaagucuacaaauuccagaagcggguucgagaugaucugggauccuaacggauggaccgaaaccgacuccucuuuuagcgucaaacaggacauuguggcgaucacagauugguccggcuauucugggagcuucguucagcaucccgagcucacgggccuggacugcauucggccuuguuucuggguggaacuuauccgcggaagacccaaggaguccaccaucuggacaagcgggucuuccauuagcuuuugcggcgucaauucugauaccgugggaugguccuggcccgacggcgccgagcugccuuucacaaucgauaaauga

SEQ ID NO: 198660 - RNA, 1350 nt, Artificial Sequence
  derived and/or modified sequence opt5 from neuraminidase__InfluenzaA__ABL67796
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcugucuacagcaaagacaacuccauuagaaucggcagcaagggggauguguuuguuauucgggagcccuucaucucuugcucccaucuggaaugucgcaccuuuuuccuuacacagggagcccugcucaaugacaagcacagcaacggcaccgugaaagauagaucuccucaucggacacugauguccugccccgucggcgaggccccuagccccuauaauucucgcuuugaauccguggcuuggagcgccuccgcuugucacgacgggaccucuuggcugacgauuggaaucagcggcccugauaacggggccguugcggugcucaaguacaauggaaucauuaccgacacaaucaaauccuggagaaacaauauucugcggacccaggagagcgagugcgccugugucaacggcucuugcuucacagugaugaccgaugggccguccaacggacaggcuagccacaagaucuuuaaaauggaaaagggcaagguggucaaaucuguugagcuugacgcccccaauuaucauuacgaagaguguagcugcuauccugaugcuggcgagauuacgugugugugccgcgacaacuggcacggguccaauagacccugggugucuuucaaccaaaaucuggaauaccagaucggauauaucugcagcggcgucuuuggggauaacccucggcccaaugacggaacaggcuccugugggccggugagcuacaacggagccuacggcguuaagggcuucucuuuuaaauaugggaauggaguguggauuggccgcaccaaguccacaaacagcagaucuggguucgagaugaucugggauccuaauggauggaccgaaaccgacuccagcuuuuccgucaaacaggacauuguggcgaucacagauuggucuggcuacagcggguccuucguucagcaucccgagcucacgggccuggacugcauucggccuuguuucuggguggaacuuauccgcggaagacccaaggagucuaccaucuggacaagcggcuccagcauuucuuuuugcggggucaacuccgauaccgugggauggagcuggcccgacggcgccgagcugccuuucacaaucgauaaauga

SEQ ID NO: 198661 - RNA, 1350 nt, Artificial Sequence
  derived and/or modified sequence opt5 from neuraminidase__InfluenzaA__ABL67807
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaaucuucugacagaaaaagcuguggccagcgugaagcucgcggggaacuccucucuguguccgaucgacggaugggcugucuacagcaaagauaauuccauuagaaucggcagcaagggggacguguucguugugcgggagcccuuuauuucuugcucccaucuugaaugucgcaccuucuuucugacacagggagcccuccugaacgauaagcacagcaauggcaccgucaaagacagaucuccucaucggacacugauguccugccccgugggcgaggccccuagccccuauaacucucgcuucgaauccguugcuuggagcgccuccgcuugucacgaugggaccucuuggcucacgaucggaauuagcggcccugacaauggggccguggcgguccugaaguacaacggaaucaucaccgauacaauuaaauccuggagaaauaacauccuucggacccaggagagcgagugcgccugugugaauggcucuugcuuuacagugaugaccgacgggccguccaacggacaggcuagccacaagauuuucaaaauggaaaagggcaaggucguuaaaucuguggagcuggaugcccccaacuaucauuacgaagaguguagcugcuauccugacgcuggcgagaucacgugugugugccgcgauaauuggcacggguccaacagacccugggucucuuuuaaucaaaaccucgaauaccagauuggauauaucugcagcggcguguucggggacaauccucggcccaacgauggagccggcuccugugggccgguuagcucuaauggagcguacggcgugaagggcuuuuccuucaaauacgggaacggagucuggaucggccgcacaaagagcaccaauucuagauccggguuugagaugauuugggacccuaacggauggacagaaaccgacagcuccuucucugugaaacaggauaucguugccauuaccgacuggagcggcuauuccgggucuuuugugcagcaucccgagcugacaggccuugauugcauccggccuuguuucugggucgaacugauucgcggaagacccaaggagagcacgaucuggaccuccggcagcucuaucuccuucugcggggugaauagcgacacagucggauggucuuggcccgauggcgcugagcucccuuuuaccauugacaaauga

SEQ ID NO: 198662 - RNA, 1350 nt, Artificial Sequence
  derived and/or modified sequence opt5 from neuraminidase__InfluenzaA__ABL67818
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaaucuucugacagaaaaagcuguggccagcgugaagcucgcggggaacuccucucuguguccgaucgacggaugggcugucuacagcaaagauaauuccauuagaaucggcagcaagggggacguguucguugugcgggagcccuuuauuucuugcucccaucuugaaugucgcaccuucuuucugacacagggagcccuccugaacgauaagcacagcaauggcaccgucaaagacagaucuccucaucggacacugauguccugccccgugggcgaggccccuagccccuauaacucucgcuucgaauccguugcuuggagcgccuccgcuugucacgaugggaccucuuggcucacgaucggaauuagcggcccugacaauggggccguggcgguccugaaguacaacggaaucaucaccgauacaauuaaauccuggagaaauaacauccuucggacccaggagagcgagugcgccugugugaauggcuauugcuuuacagugaugaccgacgggccgucuaacggacaggcuucccacaagauuuucaaaauggaaaagggcaaggucguuaaaagcguggagcuggaugcccccaacuaccauuaugaagaguguucuugcuacccugacgcuggcgagaucacgugugugugccgcgauaauuggcacgggagcaacagacccugggucuccuuuaaucaaaaccucgaauaucagauuggauacaucugcucuggcguguucggggacaauccucggcccaacgauggagccggcagcugugggccgguuuccagcaauggagcguacggcgugaagggcuuuucuuucaaauaugggaacggagucuggaucggccgcacaaaguccaccaauagcagaucuggguuugagaugauuugggacccuaacggauggacagaaaccgacuccagcuucuccgugaaacaggauaucguugccauuaccgacuggucuggcuacagcggguccuuugugcagcaucccgagcugacaggccuugauugcauccggccuuguuucugggucgaacugauucgcggaagacccaaggagucuacgaucuggaccagcggcuccagcaucucuuucugcggggucaauuccgacacagugggauggagcuggcccgauggcgcugagcucccuuuuaccauugacaaauga

SEQ ID NO: 198663 - RNA, 1350 nt, Artificial Sequence
  derived and/or modified sequence opt5 from neuraminidase__InfluenzaA__ABL67829
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaaucuucugacagaaaaagcuguggccagcgugaagcucgcggggaacuccucucuguguccgaucaauggaugggcugucuacagcaaagacaacuccauuagaaucggcagcaagggggauguguucguugugcgggagcccuuuauuucuugcucccaucuugaaugucgcaccuucuuucugacacagggagcccuccugaaugacaagcacagcaacggcaccgucaaagauagaucuccucaucggacacugauguccugccccgugggcgaggccccuagccccuauaauucucgcuucgaauccguugcuuggagcgccuccgcuugucacgacgggaccucuuggcucacgaucggaauuagcggcccugauaacggggccguggcgguccugaaguacaauggaaucaucaccgacacaauuaaauccuggagaaacaauauccuucggacccaggagagcgagugcgccugugugaacggcuuuugcuucacagugaugaccgaugggccgucuaacggacaggcuucccacaagauuuuuaaaauggaaaagggcaaggucguuaaaagcguggagcuggacgcccccaauuaucauuacgaagaguguucuugcuauccugaugcuggcgagaucacgugugugugccgcgacaacuggcacgggagcaauagacccugggucuccuucaaccaaaaucucgaauaccagauuggauauaucugcucuggcguguuuggggauaacccucggcccaaugacggagccggcagcugugggccgguugcguccaacggagccuacggcgugaagggcuucagcuuuaaauacgggaauggagucuggaucggccgcacaaagucuaccaacuccagaagcggguucgagaugauuugggauccuaauggauggacagaaaccgacucuuccuuuagcgugaaacaggacaucguugcuauuaccgauugguccggcuauucugggagcuucgugcagcaucccgagcugacaggccuugacugcauccggccuuguuucugggucgaacugauucgcggaagacccaaggaguccacgaucuggaccucuggcagcuccaucagcuuuugcggggugaacucugauacagucggaugguccuggcccgacggcgccgagcucccuuucaccauugauaaauga

SEQ ID NO: 198664 - RNA, 1410 nt, Artificial Sequence; identical to SEQ ID NO: 197736
  derived and/or modified sequence opt5 from neuraminidase__InfluenzaA__ABM22018

SEQ ID NO: 198665 - RNA, 1413 nt, Artificial Sequence; identical to SEQ ID NO: 198580
  derived and/or modified sequence opt5 from neuraminidase__InfluenzaA__ABM22029

SEQ ID NO: 198666 - RNA, 1410 nt, Artificial Sequence; identical to SEQ ID NO: 197738
  derived and/or modified sequence opt5 from neuraminidase__InfluenzaA__ABM22040

SEQ ID NO: 198667 - RNA, 1410 nt, Artificial Sequence; identical to SEQ ID NO: 198645
  derived and/or modified sequence opt5 from neuraminidase__InfluenzaA__ABM22062

SEQ ID NO: 198668 - RNA, 1410 nt, Artificial Sequence
  derived and/or modified sequence opt5 from neuraminidase__InfluenzaA__ABM22073
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuuaaccugggaaccagacaggucuguaucgccuggagcuccagcucuugccaugacggcaaggcuuggcuucacguguguguuacaggcgaugacgagaaugccaccgcuuccuucauuuacaacgggaaacugguggauagcaucggaucuugguccaagaaaauucuccggacccaggaaagcgagugcgucuguaucaacggcacaugcgccguggugaugacggacgggucugcguccggaaaggccgauaccaaaauucuguuuaucgaggaaggcaagaucguccauauuagcacacuuuccgggucugcucaacacguugaggaaugcagcuguuauccucgcuaccccggagugagaugcgugugucgggacaauuggaagggcuccaaccgcccuaucgucgauauuaaugugaaagacuacagcaucguuucuuccuaugugugcagcggccuggucggggacacccccagaaagaacgauucuuucagcuccucucacugucucgacccgaauaacgaggaaggaggccauggggugaaaggaugggccuuugaugacggcaaugauguuuggauggggcggacaauuagcgagaagcugcgcuccggauacgagaccuucaaagugaucgaaggcuggagcaagccuaacucuaaacugcagacgaauagacaggucaucguggagcggggcaaccgcuccggguauagcggaaucuuuucugucgaaggcaaguccugcauuaauagauguuucuacguggagcucauucgggggagaaaggaagagacagagguuugguggaccagcaacuccaucguggucuuuugcggaaccucuggcacauaugggaccggcagcuggcccgacggagcugauauuaaucugaugccuaucuga

SEQ ID NO: 198669 - RNA, 1410 nt, Artificial Sequence; identical to SEQ ID NO: 197615
  derived and/or modified sequence opt5 from neuraminidase__InfluenzaA__ABM22084

SEQ ID NO: 198670 - RNA, 1410 nt, Artificial Sequence
  derived and/or modified sequence opt5 from neuraminidase__InfluenzaA__ABM22095
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggccaugcugugcgaacccacaaucauugagagaaauaucaccgaaauugugcaccucacaaacaccacgaucgagaaggaaauuuguccuaaacugguggaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucacguguguguuacaggcgaugacaaaaacgccaccgcuuccuucauuuacaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccauauuagcacccuuuccgggucugcccaacacguugaagagugcagcuguuauccuagauaccccggagugcggugcgugugucgcgacaacuggaagggcuccaauagaccuaucgucgauauuaacgugaaagacuauagcaucguuucuuccuacgugugcagcggccuggucggggacacaccccggaagaaugauucuuucagcuccucucauugucucgacccgaacaaugaagagggaggccacggggugaaaggaugggcuuuugaugacggcaacgauguuuggauggggcgcaccauuagcgaaaagcugagauccggauacgagacguucaaagugaucgagggcuggagcaagccuaauucuaaacugcagaucaaccggcaggucauuguggaacgcggcaauagauccggguauagcggaaucuuuucugucgagggcaaguccugcauuaaccgguguuucuacguggaacucaucagagggcgcaaggaggaaacagagguuugguggaccagcaauuccauuguggucuuuugcggaaccucuggcacauaugggaccggcagcuggcccgacggagccgauaucaaccugaugccuauuuga

SEQ ID NO: 198671 - RNA, 1410 nt, Artificial Sequence; identical to SEQ ID NO: 197615
  derived and/or modified sequence opt5 from neuraminidase__InfluenzaA__ABM22106

SEQ ID NO: 198672 - RNA, 1410 nt, Artificial Sequence; identical to SEQ ID NO: 197615
  derived and/or modified sequence opt5 from neuraminidase__InfluenzaA__ABM22117

SEQ ID NO: 198673 - RNA, 1410 nt, Artificial Sequence; identical to SEQ ID NO: 198626
  derived and/or modified sequence opt5 from neuraminidase__InfluenzaA__ABM22128

SEQ ID NO: 198674 - RNA, 1410 nt, Artificial Sequence
  derived and/or modified sequence opt5 from neuraminidase__InfluenzaA__ABM22139
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcgagaaggccgauacaaaaauccucuuuaucgaagagggcaagauuguucacaccuccacacugucugggagcgcgcaacacguggaagagugcuccugcuauccucgcuaccccggagugagaugugucugccgggacaacuggaagggcagcaaucgcccuaucguggauauuaacaucaaagacuacucuauuguuuccagcuauguguguucugggcuugucggagacacccccagaaagaaugauagcuccucuagcucccauugccuggacccgaacaaugaagagggcggccacggggugaaaggaugggccuucgaugacggcaacgauguuuggauggggcggacgaucagcgagaagcuccgcucuggauacgaaacauuuaaagugaucgagggcugguccaauccuaacagcaagcugcagauuaauagacaggucaucguggaccgggggaaccgcucuggauauuccggcauuuucagcgucgaaggcaaauccuguaucaauagaugcuuuuacguggagcugauucgggggagaaaggaagagaccgagguucucuggaccucuaacagcaucguggucuucuguggaacauccggcaccuaugggacaggaucuuggcccgauggcgcugacauuaaucugaugccuaucuga

SEQ ID NO: 198675 - RNA, 1410 nt, Artificial Sequence
  derived and/or modified sequence opt5 from neuraminidase__InfluenzaA__ABM22150
augaaccccaaucagaagaucauuaccaucggcagcgugucccugacaauuucuacgaucugcuucuuuaugcaaauugccauccucaucaccacagucacccugcacuucaaacaguacgaguuuaacagccuuccuaauaaccagguuaugcugugugaaccgacaauuaucgagagaaauauuaccgaaaucguguaucucacaaacaccacgauugagaaggaaaucugccccgagcuggcugaguaccggaauugguccaaaccucagugugacauuaccggguucgcccccuuuucuaaggauaacagcauccgccuuuccgcgggaggcgacaucugggugacaagagaaccuuaugucucuugcgaucccgacaaauguuaccaauucgcucuggggcagggaaccacacucaauaacgugcauagcaaugauaccguucacgaccggacgccuuaucgcacacugcugaugaacgagcucggcgugccguuucaucuggggaccaagcaggucugcauugccugguccucuagcuccugucacgauggaaaggccuggcuucaugugugcguuacaggcgacgauaaaaaugcuaccgccagcuucaucuacaacggcagacugguggacucuauugucuccuggagcaagaaaauccuccggacccaggaaucugagugugugugcauuaaugggacauguacgguggucaugaccgauggauccgcuagcggcaaggccgacacaaaaauccuguuuaucgaggaagggaagauuguucacaccuccacacuuucuggaagcgcgcaacacguggaggaaugcuccugcuauccccgcuacccuggcgugagaugugucugccgggauaacuggaaggggagcaaccgccccaucguggacauuaauaucaaagacuacucuauuguuuccagcuauguguguucuggacuggucggcgauaccccuagaaagaacgacagcuccucuagcucccauugccucgaucccaauaacgaggaaggcgggcacggagugaaaggcugggccuucgacgaugggaaugacguuuggaugggacggacgaucagcgagaagcugcgcucuggcuacgagacauuuaaagugaucgaagggugguccaacccgaauagcaagcugcagauuaacagacaggucaucguggaucggggaaaucgcucuggcuauuccggcauuuucagcgucgaggggaaauccuguaucaacagaugcuuuuacguggaacucauucggggaagaaaggaggaaaccgagguucuguggaccucuaauagcaucguggucuucuguggcacauccgggaccuauggaacaggcucuuggccugacggggcugauauuaaccuuaugcccaucuga

SEQ ID NO: 198676 - RNA, 1413 nt, Artificial Sequence; identical to SEQ ID NO: 198083
  derived and/or modified sequence opt5 from neuraminidase__InfluenzaA__ABM22161

SEQ ID NO: 198677 - RNA, 1413 nt, Artificial Sequence; identical to SEQ ID NO: 198083
  derived and/or modified sequence opt5 from neuraminidase__InfluenzaA__ABM22172

SEQ ID NO: 198678 - RNA, 1413 nt, Artificial Sequence; identical to SEQ ID NO: 198083
  derived and/or modified sequence opt5 from neuraminidase__InfluenzaA__ABM22183

SEQ ID NO: 198679 - RNA, 1413 nt, Artificial Sequence; identical to SEQ ID NO: 198083
  derived and/or modified sequence opt5 from neuraminidase__InfluenzaA__ABM22194

SEQ ID NO: 198680 - RNA, 1413 nt, Artificial Sequence; identical to SEQ ID NO: 198083
  derived and/or modified sequence opt5 from neuraminidase__InfluenzaA__ABM22205

SEQ ID NO: 198681 - RNA, 1413 nt, Artificial Sequence; identical to SEQ ID NO: 198083
  derived and/or modified sequence opt5 from neuraminidase__InfluenzaA__ABM22216

SEQ ID NO: 198682 - RNA, 1413 nt, Artificial Sequence; identical to SEQ ID NO: 198083
  derived and/or modified sequence opt5 from neuraminidase__InfluenzaA__ABM22227

SEQ ID NO: 198683 - RNA, 1413 nt, Artificial Sequence; identical to SEQ ID NO: 198083
  derived and/or modified sequence opt5 from neuraminidase__InfluenzaA__ABM22238

SEQ ID NO: 198684 - RNA, 1413 nt, Artificial Sequence
  derived and/or modified sequence opt5 from neuraminidase__InfluenzaA__ABM22271
augaaccccaaucagaagaucauuaccaucggcagcauuuccaucgugauugggaucaucucucugauucuccaaaucggaaacauuaucagcauuugggccucccacucuauccagacaggcagccagaaucauacggggauuugcaaccagagaaucaucaccuacgaaaauuccacaugggucaaccaaaccuauguuaauauuaacaauacaaacgugguggcuggaaaagacaagaccucuaugacacuggccggcaauagcucccuuuguccuauccgggggugggcgauuuacaccaaagauaacagcauccgcauuggaucuaagggcgacgucuucgugaucagagagccguuuaucuccugcagccaccuggagugucggacguucuuucucacccagggcgcucugcuuaaugauaaacauucuaacgggacaguuaaggaccgcucccccuauagagcccugaugagcugcccucucggagaagcccccucuccuuacaauucccgguucgagagcguggcuugguccgccucugcuugucacgauggccugggguggcugaccauuggaaucagcggccccgacaacggggccgucgcggugcucaaguauaacggaauuaucacagaaaccauuaaauccuggaagaaacgcauccugagaacgcaggagagcgagugcguuuguaugaauggcucuugcuuuacaaucaugaccgauggcccuuccaacggggccgcuagcuaccggauuuucaagaucgaaaaaggacgcgugacaaagucuauugagcuuggcgccccgaauuaucauuacgaagaguguagcugcuaccccgacaccgggaccgucaugugugugugcagagauaacuggcacggauccaaucggccuugggugucuuuuaaccagaaucuggacuaucaaaucggcuacauuugcagcggggucuucggagauaacccccgcccuaaggacggcgagggcuccuguaaucccguuacaguggauggggcugacggagugaaaggcuuuagcuauagauacgggaacggagucuggaucggccggacgaagucuaaucgccucagaaaaggguucgaaaugauuugggacccgaacggcuggaccgauacagacuccgauuuuagcaugaagcaggacaucguggccaugaccgauuggucuggauauuccggcagcuucguucagcacccugagcugacagggcuugacugcaugcggcccuguuuuuggguggaacuggucagaggacucccucgcgagaauaccacgaucuggacauccggcucuagcauuuccuucugcggggugaacucugauaccgcgaauuggagcuggcccgacggagccgaacugcccuucaccaucgauaaauga

SEQ ID NO: 198685 - RNA, 1413 nt, Artificial Sequence; identical to SEQ ID NO: 197992
  derived and/or modified sequence opt5 from neuraminidase__InfluenzaA__ABM22282

SEQ ID NO: 198686 - RNA, 1410 nt, Artificial Sequence; identical to SEQ ID NO: 197367
  derived and/or modified sequence opt5 from neuraminidase__InfluenzaA__ABM22304

SEQ ID NO: 198687 - RNA, 1410 nt, Artificial Sequence; identical to SEQ ID NO: 197367
  derived and/or modified sequence opt5 from neuraminidase__InfluenzaA__ABM22315

SEQ ID NO: 198688 - RNA, 1410 nt, Artificial Sequence; identical to SEQ ID NO: 197367
  derived and/or modified sequence opt5 from neuraminidase__InfluenzaA__ABM22326

SEQ ID NO: 198689 - RNA, 1410 nt, Artificial Sequence; identical to SEQ ID NO: 197367
  derived and/or modified sequence opt5 from neuraminidase__InfluenzaA__ABM22337

SEQ ID NO: 198690 - RNA, 1410 nt, Artificial Sequence; identical to SEQ ID NO: 197370
  derived and/or modified sequence opt5 from neuraminidase__InfluenzaA__ABM22348

SEQ ID NO: 198691 - RNA, 1410 nt, Artificial Sequence; identical to SEQ ID NO: 197370
  derived and/or modified sequence opt5 from neuraminidase__InfluenzaA__ABM22359

SEQ ID NO: 198692 - RNA, 1410 nt, Artificial Sequence; identical to SEQ ID NO: 197370
  derived and/or modified sequence opt5 from neuraminidase__InfluenzaA__ABM22370

SEQ ID NO: 198693 - RNA, 1413 nt, Artificial Sequence; identical to SEQ ID NO: 197949
  derived and/or modified sequence opt5 from neuraminidase__InfluenzaA__ABM66867

SEQ ID NO: 198694 - RNA, 1413 nt, Artificial Sequence; identical to SEQ ID NO: 198083
  derived and/or modified sequence opt5 from neuraminidase__InfluenzaA__ABM66900

SEQ ID NO: 198695 - RNA, 1413 nt, Artificial Sequence; identical to SEQ ID NO: 198083
  derived and/or modified sequence opt5 from neuraminidase__InfluenzaA__ABM66911

SEQ ID NO: 198696 - RNA, 1410 nt, Artificial Sequence; identical to SEQ ID NO: 197370
  derived and/or modified sequence opt5 from neuraminidase__InfluenzaA__ABM66922

SEQ ID NO: 198697 - RNA, 1410 nt, Artificial Sequence; identical to SEQ ID NO: 197370
  derived and/or modified sequence opt5 from neuraminidase__InfluenzaA__ABM66933

SEQ ID NO: 198698 - RNA, 1410 nt, Artificial Sequence; identical to SEQ ID NO: 197370
  derived and/or modified sequence opt5 from neuraminidase__InfluenzaA__ABM66944

SEQ ID NO: 198699 - RNA, 1410 nt, Artificial Sequence; identical to SEQ ID NO: 197370
  derived and/or modified sequence opt5 from neuraminidase__InfluenzaA__ABM66955

SEQ ID NO: 198700 - RNA, 1410 nt, Artificial Sequence; identical to SEQ ID NO: 197370
  derived and/or modified sequence opt5 from neuraminidase__InfluenzaA__ABM66966

SEQ ID NO: 198701 - RNA, 1410 nt, Artificial Sequence; identical to SEQ ID NO: 197370
  derived and/or modified sequence opt5 from neuraminidase__InfluenzaA__ABM66977

SEQ ID NO: 198702 - RNA, 1410 nt, Artificial Sequence; identical to SEQ ID NO: 197370
  derived and/or modified sequence opt5 from neuraminidase__InfluenzaA__ABM66988

SEQ ID NO: 198703 - RNA, 1410 nt, Artificial Sequence; identical to SEQ ID NO: 197370
  derived and/or modified sequence opt5 from neuraminidase__InfluenzaA__ABM66999

SEQ ID NO: 198704 - RNA, 1410 nt, Artificial Sequence; identical to SEQ ID NO: 197370
  derived and/or modified sequence opt5 from neuraminidase__InfluenzaA__ABM67010

SEQ ID NO: 198705 - RNA, 1410 nt, Artificial Sequence; identical to SEQ ID NO: 197370
  derived and/or modified sequence opt5 from neuraminidase__InfluenzaA__ABM67021

SEQ ID NO: 198706 - RNA, 1413 nt, Artificial Sequence
  derived and/or modified sequence opt5 from neuraminidase__InfluenzaA__ABM67054
augaaccccaaucagaagaucauuaccaucggcagcauuuccaucgccauugggacaaucucucugaugcuccaaaucggaaacaugauuagcaucugggcuucccacucuauucagacgggcagccagaaucauaccgggaucugcaaccagagaauuaucacauacgaaaauuccaccugggugaaccacacauaugucaauauuaacaauaccaacguuguggccggaaaagacaagacaucugugacccuggcgggcaauagcucccuuuguagcaucucugggugggcuaucuacacgaaagauaacuccauucggaucggaagcaagggcgacgucuucgugauucgcgagccuuuuaucucuugcucccaucuggaguguagaaccuucuuucucacacaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaaucauuaccgaaacgaucaagucuuggaaaaagcggauucucagaacacaggaguccgagugcguuugugugaauggcagcugcuuuaccaucaugacagauggccccucuaacggggcugccagcuacaaaauuuucaagaucgaaaagggaaaagucaccaaguccaucgagcugaaugcuccuaacuuucacuaugaagaguguucuugcuacccggacaccggcacagugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacgguggauggcgccgacggggucaaaggauucuccuacaaguauggcaaugggguguggauuggacgcaccaaaagcaacagacugcggaagggcuuugagaugaucugggaccccaauggguggacagauaccgacucugauuucuccguuaagcaagacguggucgcgauuacagauuggagcggcuacuccggaucuuuugugcagcauccggaacucaccggccuggacugcauccgcccuuguuucuggguugagcuugugagagggcugccccgggaaaacacgacaauuuggaccagcggauccucuaucagcuucugcggcgucgauuccgacaccgccaauuggagcuggccugauggggcugagcuccccuuuacaaucgacaaauga

SEQ ID NO: 198707 - RNA, 1350 nt, Artificial Sequence
  derived and/or modified sequence opt5 from neuraminidase__InfluenzaA__ABM68048
augaaccccaaucagaagaucauuaccaucggcagcauuugcauggugaucgggauugucucccugaugcuccaaaucggaaacaucauuucuaucuggauuagccacuccauccagacaggcaaucagugucaggccgggccuauuucuaacacgaaauuccugaccgagaaggcuguugccagcgugacacuugcgggaaauuccucucugugcccgaucagcggcugggcuguguacuccaaagacaacagcauuagaaucgggucucggggagaugucuuugugauccgcgaauccuucauuagcuguucucaucucgagugcagaaccuuuuuccugacacaaggcgcccuucugaaugacaagcacuccaacggcaccguuaaagaucggagcccccaucgcacacucaugucuuguccugugggggaagcccccuccccuuauaauagcagauuugaguccgucgcuuggucugccagcgcuugccacgacggaaccuccuggcugacgaucggcauuagcgggcccgauaacggagccguggcgguucugaaguacaauggcaucauuaccgacacaaucaagucuuggcggaacaauauccuccgcacccaggaauccgagugugccugcgugaacgggagcuguuucacagucaugaccgauggaccuucuaauggccaggcuagcuauaaaauuuuuaagauggagaaaggcaagguggugaaauccgucgaacuggacgccccgaacuaccauuaugaggaaugcucuuguuaccccgaugcuggggagaucacgugcguuugcagagacagcuggcacggauccaaccggccuugggugagcuucaaucagaaccuugaguaucaaauuggcuacaucuguucugggguguuuggagauaauccccgcccuaacgacggcacaggguccugcggacccgucagcccgaauggcgccuacggcgugaagggguucucuuuuaaguauggaaacggcguuuggauugggagaaccaaauccacaaauagccgguccggauucgaaaugaucugggauccuaacggcuggaccgggaccgacucuagcuuuuccgugaagcaggacaucgucgcgauuacagauuggucuggcuacagcggauccuucgugcagcaccccgagcugacgggccucgacuguauccgcccuugcuucuggguugaacugauuagagggcggcccaaagagagcaccaucuggacaucuggauccagcauuucuuuuuguggcgucaauuccgauaccgugagcuggucuuggcccgacggggccgaacuuccuuucacaaucgauaaguga

SEQ ID NO: 198708 - RNA, 1350 nt, Artificial Sequence
  derived and/or modified sequence opt5 from neuraminidase__InfluenzaA__ABM68049
augaaccccaaucagaagaucauuaccaucggcagcauuugcauggugaucgggauugucucccugaugcuccaaaucggaaacaucauuucuaucuggauuagccacuccauccagacaggcaaucagugucaggccgagccuauuucuaacacgaaauuccugaccgaaaaggcuguugccagcgugacacuugcgggaaauuccucucugugcccgaucagcgggugggcuguguacuccaaagacaacagcauuagaaucggcucucgcggggaugucuuugugauccgggagcccuucauuuccuguagccaucucgaaugcagaaccuuuuuccugacacaaggagcccuucugaaugacaagcacucuaacggcaccguuaaagaucgguccccucaucgcacacucaugagcugucccgugggcgaggccccuucucccuauaauuccagauuugaaagcgucgcuugguccgccucugcuugccacgacgggaccagcuggcugacgaucggaauuuccggcccugauaacggggccguggcgguucugaaguacaauggaaucauuaccgacacaaucaagagcuggcggaacaauauccuccgcacccaggagucugagugugccugcgugaacggcuccuguuucacagucaugaccgaugggccgagcucuggacaggcuagcuauaaaauuuuuaagauggaaaaaggcaagguggugaaauccgucgagcuggacgcccccaauuaccauuaugaagagugcucuuguuacccugaugcuggcgagaucacgugcguuugcagagacagcuggcacggguccaaccggcccugggugagcuucaaccagaaucuugaauaucaaauuggauacaucuguucuggcguguuuggggauaacccucgccccaaugacggaacaggcuccugcgggccggucagcccuaacggagccuacggcgugaagggcuucucuuuuaaguaugggaauggaguuuggauuggcagaaccaaauccacaaacagccgguccggguucgagaugaucugggaucccaauggauggaccggcaccgacucuagcuuuuccgugaagcaggacaucgucgcgauuacagauuggucuggguacagcggcuccuucgugcagcacccugaacugacgggacucgacuguauccgccccugcuucuggguugagcugauuagaggccggcccaaagaaagcaccaucuggacaucuggguccagcauuucuuuuuguggagugaacuccgauaccgucagcuggucuuggccugacggcgccgagcuuccguucacaaucgauaaguga

SEQ ID NO: 198709 - RNA, 1350 nt, Artificial Sequence
  derived and/or modified sequence opt5 from neuraminidase__InfluenzaA__ABM90436
augaaccccaaucagaagaucauuaccaucggcagcauuugcauggugaucgggauugucucccugaugcuccaaaucggaaacaugaucucuauuuggguuagccacuccauccagaaaggcaaucagcaucaggccgagucuauuagcaacacaaauccucugacggaaaaggcuguggccuccgugacccuugcggggaacucuagccuguguccgaucagaggaugggcuguccacuccaaagacaauaacauucggaucggcagcaagggggauguguucguuauucgcgagcccuuuaucucuugcucccaucucgaauguagaacauucuuucugacccaaggagcccuucugaaugacaaacacagcaacggcacagugaaggaucggucuccucaucgcacccucauguccugccccgucggcgaggccccuagccccuacaauucuagauucgaauccguggcuuggagcgccuccgcuugucacgacgggacaucuuggcugaccaucggaauuagcggcccugauaacgaggccguugcggugcugaaguauaaugggaucauuacggacaccaucaaauccuggcggaacaauauucuccgcacacaggagagcgaaugcgccugugucaacggaucuugcuuuaccgugaugacagauggcccguccaacgggcaggcuagcuacaagaucuucaaaaugaagaaaggaaagguggucaagucuguugagcuggacgcccccaauuaucacuacgaagaguguagcugcuauccugaugcuggcgagaucaccugugugugcagagacaacuggcauggcuccaaucggcccugggugucuuuuaaccagaaucuugaauaccaaauuggguauaucugcagcggagucuucggcgauaacccucgccccaaugacgggacgggauccuguggcccgaugagcccuaacggggccuacggagugaaaggcuuuucuuucaaguacggcaaugggguuuggauuggaagaacaaaauccaccaacagccggucuggcuuugagaugaucugggaucccaauggguggacaggaaccgacuccagcuucuccgugaagcaggacauugucgcgaucaccgauuggucuggcuauagcggguccuuugugcagcacccugaacugacaggccucgacugcauccgccccuguuucuggguugagcugauuagaggacggcccaaagaaucuacgaucuggaccagcggcuccagcauuucuuucugcggggugaacuccgauacagucagcuggucuuggccugacggagccgagcuuccguuuaccaucgauaaguga

SEQ ID NO: 198710 - RNA, 1350 nt, Artificial Sequence; identical to SEQ ID NO: 198709
  derived and/or modified sequence opt5 from neuraminidase__InfluenzaA__ABM90447

SEQ ID NO: 198711 - RNA, 1350 nt, Artificial Sequence; identical to SEQ ID NO: 198709
  derived and/or modified sequence opt5 from neuraminidase__InfluenzaA__ABM90458

SEQ ID NO: 198712 - RNA, 1350 nt, Artificial Sequence; identical to SEQ ID NO: 198709
  derived and/or modified sequence opt5 from neuraminidase__InfluenzaA__ABM90469

SEQ ID NO: 198713 - RNA, 1350 nt, Artificial Sequence
  derived and/or modified sequence opt5 from neuraminidase__InfluenzaA__ABM90491
augaaccccaaucagaagaucauuaccaucggcagcauuugcauggugaucgggauugucucccugaugcuccaaaucggaaacaugaucucuauuuggguuagccacuccauccagaaaggcaaucagcaucaggccgagucuauuagcaacacaaauccucugacggaaaaggcuguggccuccgugacccuugcggggaacucuagccuguguccgaucagaggaugggcuguccacuccaaagacaauaacauucggaucggcagcaagggggauguguucguuauucgcgagcccuuuaucucuugcucccaucucgaauguagaacauucuuucugacccaaggagcccuucugaaugacaaacacagcaacggcacagugaaggaucggucuccucaucgcacccucauguccugccccgucggcgaggccccuagccccuacaauucuagauucgaauccguggcuuggagcgccuccgcuugucacgacgggacaucuuggcugaccaucggaauuagcggcccugauaacgaggccguugcggugcugaaguauaaugggaucauuacggacaccaucaaauccuggcggaacaauauucuccgcacacaggagagcgaaugcgccugugucaacggaucuugcuuuaccgugaugacagauggcccguccaacgggcaggcuagcuacaagaucuucaaaaugaagaaaggaaaggugaucaagucugucgagcuggacgccaccaauuaucacuacgaagaguguagcugcuaucccgaugcuggcgagauuacguguguuugcagagacaacuggcauggcuccaaucggccuugggugucuuuuaaccagaaucuugaauaccaaaucggguauauuugcagcggaguguucggcgauaacccccgcccuaaugacgggacaggauccuguggccccaugagcccgaacggggccuacggagucaaaggcuuuucuuucaaguacggcaaugggguguggaucggaagaaccaaauccacaaacagccggucuggcuuugagaugauuugggauccuaauggguggaccggaaccgacuccagcuucuccguuaagcaggacaucguggcgaucacagauuggucuggcuauagcggguccuuuguccagcaccccgaacugacgggccucgacugcauucgcccuuguuucuggguggagcugaucagaggacggcccaaagaaucuaccauuuggacaagcggcuccagcaucucuuucugcgggguuaacuccgauaccgugagcuggucuuggcccgacggagccgagcuuccuuuuacaauugauaaguga

SEQ ID NO: 198714 - RNA, 1350 nt, Artificial Sequence; identical to SEQ ID NO: 198713
  derived and/or modified sequence opt5 from neuraminidase__InfluenzaA__ABM90502

SEQ ID NO: 198715 - RNA, 1350 nt, Artificial Sequence
  derived and/or modified sequence opt5 from neuraminidase__InfluenzaA__ABM90524
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagucuauuagcaacacgaauccucugaccgaaaaagcugugguguccgucacacuugccgggaacucuagccuguguccgaucagaggaugggcggugcacuccaaggacaauaacauucggaucggcagcaaaggggauguuuucgugauucgcgagcccuuuaucucuugcucccaucucgaauguagaaccuucuuucugacacaaggagcccuucugaaugacaagcacagcaacggcaccgucaaagaucggucuccucaucgcacacucauguccugccccgugggcgaggcuccuagccccuacaauucuagauucgaauccguugccuggagcgcuuccgccugucacgacgggaccucuuggcugacgaucggaauuagcggcccugauaacgaggcuguggccguccugaaguauaaugggaucauuaccgacacaaucaaguccuggcggaacaauauucuccgcacccaggagagcgaaugcgcgugugugaacggaucuugcuuuacagugaugaccgauggcccguccaacgggcaggccagcuacaaaaucuucaagauggagaaaggaaaggucguuaaaucuguggaacuggacgcucccaauuaucacuacgaggaguguagcugcuauccugaugccggcgaaaucacgugugugugcagagacaacuggcauggcuccaaucggcccugggucucuuuuaaccagaaucuugaguaccaaauuggguauaucugcagcggaguguucggcgauaacccucgccccaaugacgggacaggauccuguggcccgaugagcccuaacggggcuuacggaguuaagggcuuuucuuucaaguacggcaaugggguguggauuggaagaaccaaauccacaaacagccggucuggcuuugaaaugaucugggaucccaauggguggaccggaaccgacuccagcuucuccgucaagcaggacauuguggccaucacagauuggucuggcuauagcggguccuuuguucagcacccugagcugacgggccucgacugcauccgccccuguuucuggguggaacugauuagaggacggcccaaagagucuaccaucuggacaagcggcuccagcauuucuuucugcggggucaacuccgauaccgugagcuggucuuggccugacggagcggagcuuccguuuacaaucgauaaguga

SEQ ID NO: 198716 - RNA, 1350 nt, Artificial Sequence; identical to SEQ ID NO: 198715
  derived and/or modified sequence opt5 from neuraminidase__InfluenzaA__ABM90535

SEQ ID NO: 198717 - RNA, 1350 nt, Artificial Sequence; identical to SEQ ID NO: 198715
  derived and/or modified sequence opt5 from neuraminidase__InfluenzaA__ABM90546

SEQ ID NO: 198718 - RNA, 1413 nt, Artificial Sequence
  derived and/or modified sequence opt5 from neuraminidase__InfluenzaA__ABN50759
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugcugaaguauaauggaauuaucacagaaaccauuaagagcuggcgcaaacagauccugagaacgcaggagucugaguguguuugcgugaacggcuccuguuuuacaaucaugaccgacggcccuagcgaugggcaagccucuuaccggauuuucaagaucgaaaaaggaaagauuacaaaaagcaucgagcucgacgcuccgaacucccauuaugaagagugcucuuguuaccccgauaccggcaccgucaugugcgugugccgcgacaauuggcacgggagcaacagaccuuggguguccuuuaaucagaaccuggauuaccagauuggauauaucuguagcggcgucuucggggacaauccccggccuaaggacggaaagggcucuugcgaucccguuaacguggacggcgccgauggggugaaaggauuuuccuaccgcuauggcaauggggucuggauuggaagaacaaagagcaacucuucccggaaaggcuucgagaugaucugggacccgaauggguggacggauaccgacagcaacuuucuugugaagcaggauguuguggcuaugacagacugguccggcuacucuggcagcuucguccaacacccugaacugaccggacucgauuguauccgccccugcuuuuggguggagcugauuagagggcggccuagagagaaaacaaccaucuggacguccggaucuagcauuuccuucuguggcguuaauagcgacacagugaacuggucuuggcccgauggggccgaacuucccuucaccaucgacaaguga

SEQ ID NO: 198719 - RNA, 1410 nt, Artificial Sequence
  derived and/or modified sequence opt5 from neuraminidase__InfluenzaA__ABN50770
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaaaagauucugcggacccaggagucugaaugugugugcaucaaugggacauguacggucguuaugaccgauggauccgcuagcggcaaagccgacacaaagauucucuuuaucgaggaggggaagaucgugcacaccuccacacugucuggaagcgcgcaacacguggaagagugcuccugcuauccucgcuaccccggcgucagaugugugugccgggauaacuggaaagggagcaaccgcccuauuguugacaucaauauuaaggacuacucuaucguguccagcuaugucuguucuggacuugugggcgauacccccagaaagaacgacagcuccucuagcucccauugccuggauccgaauaacgaagagggcgggcacggaguuaaaggcugggccuucgacgaugggaaugacguguggaugggacggacgauuagcgaaaaacuccgcucuggcuacgagacauuuaaggucaucgaggggugguccaacccuaauagcaaacugcagaucaacagacaggugauugucgaucggggaaaucgcucuggcuauuccggcaucuucagcguggaagggaaguccuguauuaacagaugcuuuuacguugagcugauccggggaagaaaggaagagaccgaagugcucuggaccucuaauagcauugucguguucuguggcacauccgggaccuauggaacaggcucuuggcccgacggggcugauaucaaccugaugccuauuuga

SEQ ID NO: 198720 - RNA, 1413 nt, Artificial Sequence
  derived and/or modified sequence opt5 from neuraminidase__InfluenzaA__ABN50903
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucaacaauacaaacgugguggcuggaaaagacaccacauccgucacccuggccggcaauucuagccuuugcccugugcgggggugggcgauuuacuccaaggauaacagcauccgcauuggaucuaaaggcgacguuuucgugaucagagaaccguuuauuuccuguagccaccuggagugccggacguucuuucucacccagggcgcucugcuuaaugauaagcauucuaacgggacagucaaagaccgcucccccuauagagcccugaugagcuguccuaucggagaagcccccucuccuuacaauucccgguucgagagcguggcuugguccgccucugcuugccacgauggcaugggguggcucaccaucggaauuagcggccccgacgauggggccguugcggugcugaaguauaacggaaucauuacagaaaccaucaaguccuggcgcaaacggauucugagaacgcaggagagcgagugugucugcgugaacggcucuuguuuuacaaucaugaccgacggcccuuccaaugggccggccagcuaccgcaucuucaagauugaaaaaggaaagaucacaaaaucuauugagcucgaugcucccaacagccauuaugaagagugcuccuguuacccugacaccggcaccgugaugugcgucugcagagauaauuggcacgggucuaaccggcccuggguuagcuuuaaucagaaccuggacuaccaaaucggauauauuuguuccggcguguucggggauaauccucgccccaaggacggaaagggcagcugcggcccggugacagucgacggggccgauggagugaaaggcuuuucuuacagauaugggaacggaguuuggaucggccggacgaaguccaauagcucucgcaaaggguucgagaugauuugggacccuaacggcuggaccgauacagacuccaauuuucuugugaagcaggaugucguggcuaugaccgacuggagcggauacuccggcucuuucauccagcaccccgaacugacagggcucgauuguaugagaccuugcuuuuggguugagcugauccggggaagaccccgcgagaaaaccacgauuuggacaagcggcuccucuaucagcuucuguggggugaacuccgacaccgucaauuggagcuggcccgauggagccgaacuuccuuucaccauugacaaguga

SEQ ID NO: 198721 - RNA, 1413 nt, Artificial Sequence; identical to SEQ ID NO: 198083
  derived and/or modified sequence opt5 from neuraminidase__InfluenzaA__ABN50920

SEQ ID NO: 198722 - RNA, 1413 nt, Artificial Sequence
  derived and/or modified sequence opt5 from neuraminidase__InfluenzaA__ABN50931
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcgcccugaugucuuguccuaucggagaagcucccuccccuuauaauagcagauucgaguccgucgccuggucugcuagcgccugccaugauggcaugggguggcucacaauuggaaucuccggccccgacgauggggcgguggccguucugaaauacaacggaauuaucaccgaaacaauuaagagcuggcggaagcgcauccugagaacccaggagucugagugugugugcgucaacggcuccuguuuuacgaucaugacagacggcccuaauaacgggccggcuagcuauaaaauuuucaagaucgaaaaaggaaagauuaccaaaucuaucgagcucgaugcccccaauagccacuacgaagagugcuccuguuacccugacgcuggcacagugaugugcgugugccgggauaacuggcaugggucuaaucgccccugggucagcuuuaaccaaaaucuggacuaucagauuggauacaucuguuccggcguuuucggggauaacccuagacccaaggacggaaagggcagcugcggcccggugaccguggacggggccgauggagucaaaggcuuuucuuaucgguacgggaauggaguguggauuggccgcaccaaguccaacagcucuagacggggguucgagaugaucugggacccuaauggcuggacagauacggacuccaaauuucuuguuaagcaggauguggucgcgaucaccgacuggagcggauauuccggcucuuucgugcagcaccccgaacugacagggcucgauuguaugcgcccuugcuuuuggguugagcugauuagaggacggcccagagaaaacaccacaaucuggaccagcggcuccucuauuagcuucuguggggugaauggagacacggccaacugguccuggcccgauggcgcugagcuuccuuucacaaucgacaaauga

SEQ ID NO: 198723 - RNA, 1413 nt, Artificial Sequence
  derived and/or modified sequence opt5 from neuraminidase__InfluenzaA__ABN50943
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcgcccugaugucuuguccuaucggagaagcucccuccccuuauaauagcagauucgaguccgucgccuggucugcuagcgccugccaugauggcaugggguggcucacaauuggaaucuccggccccgacgauggggcgguggccguucugaaauacaacggaauuaucaccgaaacaauuaagagcuggcggaagcgcauccugagaacccaggagucugagugugugugcgucaacggcuccuguuuuacgaucaugacagacggcccuaauaacgggccggcuagcuauaaaauuuucaagaucgaaaaaggaaagauuaccaaaucuaucgagcucgaugcccccaauagccacuacgaagagugcuccuguuacccugacgcuggcacagugaugugcgugugccgggauaacuggcaugggucuaaucgccccugggucagcuuuaaccaaaaucuggacuaucagauuggauacaucuguuccggcguuuucggggauaacccuagacccaaggacggaaagggcagcugcggcccggugaccguggacggggccgauggagucaaaggcuuuucuuaucgguacgggaauggaguguggauuggccgcaccaaguccaacagcucuagacggggguucgagaugaucugggacccuaauggcuggacagauacggacuccaaauuucuuguuaagcaggauguggucgcgaugaccgacuggagcggauauuccggcucuuucgugcagcaccccgaacugacagggcucgauuguaugcgcccuugcuuuuggguugagcugaucagaggacggcccagagaaaacaccacaauuuggaccagcggcuccucuaucagcuucuguggggugaauggagacacggccaacugguccuggcccgauggcgcugagcuuccuuucacaauugacaaauga

SEQ ID NO: 198724 - RNA, 1413 nt, Artificial Sequence; identical to SEQ ID NO: 197992
  derived and/or modified sequence opt5 from neuraminidase__InfluenzaA__ABN50954

SEQ ID NO: 198725 - RNA, 1413 nt, Artificial Sequence; identical to SEQ ID NO: 197992
  derived and/or modified sequence opt5 from neuraminidase__InfluenzaA__ABN50965

SEQ ID NO: 198726 - RNA, 1413 nt, Artificial Sequence; identical to SEQ ID NO: 197992
  derived and/or modified sequence opt5 from neuraminidase__InfluenzaA__ABN50976

SEQ ID NO: 198727 - RNA, 1410 nt, Artificial Sequence; identical to SEQ ID NO: 197367
  derived and/or modified sequence opt5 from neuraminidase__InfluenzaA__ABN50987

SEQ ID NO: 198728 - RNA, 1410 nt, Artificial Sequence; identical to SEQ ID NO: 197370
  derived and/or modified sequence opt5 from neuraminidase__InfluenzaA__ABN50998

SEQ ID NO: 198729 - RNA, 1410 nt, Artificial Sequence
  derived and/or modified sequence opt5 from neuraminidase__InfluenzaA__ABN51013
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccugugccucgacccgaacaaugaggaaggcgggcauggagugaaaggcugggccuucgaugacgggaacgauguuuggaugggacggacgaucagcgagaagcugcgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacucauucggggaagaaaggaggaaaccgagguucuguggaccucuaacagcaucguggucuucuguggcacauccgggaccuauggaacaggcucuuggcccgauggggcugacauuaaucuuaugccuaucuga

SEQ ID NO: 198730 - RNA, 1410 nt, Artificial Sequence
  derived and/or modified sequence opt5 from neuraminidase__InfluenzaA__ABN51024
augaaccccaaucagaagaucauuaccaucggcagcgugucccugacagucucuacgauuugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccaguguaacaucaccggguucgccccuuuuucuaaagacaauagcauucgccuguccgcgggaggcgauaucugggucacaagagagcccuaugugucuugcgacccugauaaguguuaccaauucgcucuugggcagggaaccacacugaacaauguucauagcaacgacaccgugcacgaucggacgccguaucgcacacuccugaugaaugaacugggcguccccuuucaucucgggaccaaacaggugugcaucgccugguccucuagcuccugucacgacggaaaggccuggcugcauguuugcgugacaggcgaugacaagaacgcuaccgccagcuucauuuacaauggcagacuugucgauucuaucguguccuggagcaaagagauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgauguguggaugggacggacgauuagcgagaagcuccgcucuggcuacgagacauuuaaagucaucgaagggugguccaauccuaacagcaagcugcagaccaauagacaggugaucgucgaccggggaaaccgcucuggcuauuccggcauuuucagcguggaggggaaauccuguaucaauagaugcuuuuacguugaacugauucggggaagaaaggaggaaaccgaggugcucuggacaucuaacagcaucgucguguucuguggcaccuccgggacauauggaacgggcucuuggcccgauggggcugacauuaaucugaugccuaucuga

SEQ ID NO: 198731 - RNA, 1410 nt, Artificial Sequence
  derived and/or modified sequence opt5 from neuraminidase__InfluenzaA__ABN51035
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacaccuccacacugucuggaagcgcgcaacacguggaagagugcuccugcuauccucgcuaccccggcgucagaugugugugccgggacaacuggaaggggagcaaccgcccuauuguugacaucaauauuaaaaacuacucuaucguguccagcuaugucuguucuggacuugugggcgauacccccagaaagacggacagcuccucuagcucccauugccuggauccgaauaacgaagagggcgggcacggaguuaaaggcugggccuucgacgaugggaaugacguguggaugggacggacaauuagcgaaaagcuccgccugggcuacgagaccuuuaaagucaucgagggguggucuaacccuaauuccaagcugcagaucaacagacaggugauugucgaucggggaaaucgcagcggcuauucuggcaucuucuccguggaagggaaaagcuguauuaacagaugcuuuuacguugagcucauccggggaagaaaggaagagaccgaagugcuguggacauccaauucuauugucguguucuguggcaccagcgggacauauggaacgggcuccuggcccgacggggcugauaucaaccuuaugccuauuuga

SEQ ID NO: 198732 - RNA, 1410 nt, Artificial Sequence; identical to SEQ ID NO: 198731
  derived and/or modified sequence opt5 from neuraminidase__InfluenzaA__ABN51046

SEQ ID NO: 198733 - RNA, 1413 nt, Artificial Sequence
  derived and/or modified sequence opt5 from neuraminidase__InfluenzaA__ABN51069
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccgauaccggcaccgugaugugugucugcagagacaacuggcacggguccaaucggccuugggugucuuuuaaccagaaucuggauuaucaaaucggauacauuugcagcggcguguucggggacaacccccgcccuaaggauggagagggcuccuguaaucccgucacaguugacggcgccgacggggugaaaggauuuagcuauagauacggcaacgggguguggaucggacggacgaagucuaaucgccucagaaaaggcuucgaaauggucugggauccgaacggguggaccgacacagauuccgacuuuagcaugaagcaggauauuguggcgaugaccgacuggucuggcuauuccggauccuucguucagcacccugagcugacaggccuugauugcaugcggcccuguuuuuggguggaacuggucagagggcucccucgcgagaauaccacgaucuggacauccggaucuagcaucuccuucugcggcgugaacucugacaccgccaauuggagcuggcccgauggggcugaacugcccuucaccauugacaaauga

SEQ ID NO: 198734 - RNA, 1413 nt, Artificial Sequence
  derived and/or modified sequence opt5 from neuraminidase__InfluenzaA__ABN51080
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccgaaaaagacaagaccucugugacacuggcgggaaauagcucccuuuguagcauuucuggcugggcuaucuacaccaaagauaacuccauucggaucgggagcaagggagacgucuucgugauucgcgagccuuuuaucucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggauuagcggaccugacaacggcgcggucgccgugcugaaauauaacgggaucauuacagagaccaucaagucuuggaaaaagcagauucucagaacgcaggaguccgaaugcguuugugugaauggaagcugcuuuacaaucaugaccgauggccccucuaacggcgcugccagcuacaaaaucuucaagauugagaaggggaaagucacaaaguccguggaacugaaugcuccuaacuuucacuaugaggaguguucuugcuacccggacaccggaaccgugaugugugucugccgggauaauuggcacggcagcaaccgccccuggguuuccuucaaucagaaccuugacuaccaaaucggguauauuugcagcggaguguuuggcgauaauccuagacccaaagacggggaaggaucuuguaacccugugacagucgauggcgccaauggcgugaagggguucuccuacaaauauggaaacggcguuuggaucgggcggacgaaguccaaucgccugagaaaaggauuugagaugauuugggaccccaacggcuggaccgacacagauucugacuucuccgugaagcaggaugucguggcgaucaccgacuggagcggguacuccggcucuuuuguucagcauccggaacucacaggacuggauugcauucggccuuguuucuggguggagcuuguccgcggccugcccaaggaaaauaccacgaucuggacaagcggguccucuaucagcuucugcggagugaacuccgacaccgccaacuggagcuggccugauggcgcugagcuccccuuuaccauugacaaauga

SEQ ID NO: 198735 - RNA, 1413 nt, Artificial Sequence; identical to SEQ ID NO: 197410
  derived and/or modified sequence opt5 from neuraminidase__InfluenzaA__ABN51091

SEQ ID NO: 198736 - RNA, 1410 nt, Artificial Sequence; identical to SEQ ID NO: 197119
  derived and/or modified sequence opt5 from neuraminidase__InfluenzaA__ABN51102

SEQ ID NO: 198737 - RNA, 1410 nt, Artificial Sequence; identical to SEQ ID NO: 197127
  derived and/or modified sequence opt5 from neuraminidase__InfluenzaA__ABN51113

SEQ ID NO: 198738 - RNA, 1410 nt, Artificial Sequence
  derived and/or modified sequence opt5 from neuraminidase__InfluenzaA__ABN51124
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugauccugggaagugcuaccaguucgcccugggacagggcaccacacuugacaacaagcauagcaaugauaccauccacgaccgggugccgcaucgcacacugcucaugaacgaacuggggguucccuuucaccugggaaccagacagguguguauugccugguccucuagcuccugccaugauggcaaggcuuggcuccacgucuguaucacgggcgacgauaaaaaugccacagcuagcuucauuuaugacgggcggcugguggauucuaucggauccuggagccaaaacauucuucgcacccaggagucugaaugcguguguaucaauggcacaugcaccgucguuaugaccgacggguccgccagcggcagagcggauacacggauccuguuuauugaggagggaaaaaucgugcacauuuccccucucucugggagcgcccagcauguggaagagugcuccuguuacccccgcuauccuggagucagaugcaucugucgggacaacuggaagggcagcaaucgccccgugguugacauuaacauggaagauuacucuaucgacuccagcuacgugugcucuggccuggucggggauacgccgagaaacgacgaucggagcuccaauucuaacugucgcaauccuaacaaugagagaggaaaccagggcgugaaagggugggcuuucgacaauggagaugacguuuggaugggccggaccaucagcaaggaucuuagauccggguaugaaacauuuaaggugauuggaggcuggagcacccccaacucuaaaucccaaaucaaucgccaggucauuguggacagcgauaaccggucuggcuacuccgggaucuucagcgucgagggaaaguccugcauuaauagauguuuuuauguggagcugauccgcggccggaaacaggaaacaagaguuugguggaccucuaacagcauuguggucuucugcgggacguccggaacauacggcaccgggucuuggccugacggcgccaauaucaacuuuaugcccaucuga

SEQ ID NO: 198739 - RNA, 1410 nt, Artificial Sequence; identical to SEQ ID NO: 197127
  derived and/or modified sequence opt5 from neuraminidase__InfluenzaA__ABN51135

SEQ ID NO: 198740 - RNA, 1413 nt, Artificial Sequence; identical to SEQ ID NO: 197420
  derived and/or modified sequence opt5 from neuraminidase__InfluenzaA__ABN51146

SEQ ID NO: 198741 - RNA, 1410 nt, Artificial Sequence
  derived and/or modified sequence opt5 from neuraminidase__InfluenzaA__ABN51157
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggagacaaagauucuguuuaucgaagagggcaaaaucguccacauuagcacccuuuccgggucugcccaacacguugaagagugcagcuguuauccuagauaccccggagugcggugcgugugucgcgauaacuggaagggcuccaauagaccuaucgucgacauuaacgugaaggauuacagcaucguuucuuccuaugugugcagcggccuggucggggacacaccccggaaaaaugacucuuucagcuccucucauugucucgauccgaacaaugaagagggaggccacggggugaagggaugggcuuuugacgauggcaacgacguuuggauggggcgcaccauuagcgagaaacugagauccggauacgaaacguucaaggugaucgagggcuggagcaaaccuaauucuaagcugcagacaaaccggcaggucaucguggaacgcggcaauagauccggguauagcggaaucuuuucugucgagggcaaauccugcauuaaccgguguuucuacguggaacucauuagagggcgcaaggaggagaccgaaguuugguggaccagcaauuccaucguggucuuuugcggaacaucuggcaccuaugggacaggcagcuggcccgauggagccgacauuaaccugaugccuaucuga

SEQ ID NO: 198742 - RNA, 1410 nt, Artificial Sequence; identical to SEQ ID NO: 198730
  derived and/or modified sequence opt5 from neuraminidase__InfluenzaA__ABN59393

SEQ ID NO: 198743 - RNA, 1365 nt, Artificial Sequence
  derived and/or modified sequence opt5 from neuraminidase__InfluenzaA__ABN59415
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugauaaacauucuuccggcacggugaaggaccggagccccuaccgcgcccugaugucuuguccuguuggggaggcgcccuccccuuauaacagcagauucgaauccguggcuuggucugccagcgccugccacgauggaaugggcuggcugaccaucgggaucuccggacccgacaauggcgcugucgccgugcucaaguacaacgggauuaucacagagaccauuaaaagcuggcggaagaaaauccugcgcacacaggaaucugagugugcuugcguuaauggauccuguuuuaccauuaugacggauggcccuagcgacggccuugccucuuauaagaucuucaaaaucgagaaggggaaggugacaaaaagcauugaacugaacgcgcccaauucccauuacgaggaaugcucuuguuauccggauaccggaaaggucaugugcgugugcagagacaacuggcacggcagcaaccggccuuggguguccuuugaucagaaucucgacuaccagaucggguacauuuguagcggagucuucggcgauaacccccgcccugaggacgggacaggaucuugcggccccguuuauguggacggcgccaauggggugaaaggauuuuccuacagauauggcaacggggucuggaucggacggaccaagagccacucuucccgccauggcuucgagaugauuugggauccgaauggguggaccgaaacagacagcaaauuuuccgugagacaagauguuguggcuaugacggacuggucuggcuacagcggauccuucguccagcacccugagcugaccggccuugauuguaugcggcccugcuuuuggguggaacugauccgcgggagaccuaaggagaaaacaauuuggaccucugccagcuccaucagcuucuguggaguuaacucugacacaguggauugguccuggcccgacggcgcugaacuccccuucagcaucgauaaguga

SEQ ID NO: 198744 - RNA, 1413 nt, Artificial Sequence; identical to SEQ ID NO: 197975
  derived and/or modified sequence opt5 from neuraminidase__InfluenzaA__ABN59426

SEQ ID NO: 198745 - RNA, 1410 nt, Artificial Sequence; identical to SEQ ID NO: 197277
  derived and/or modified sequence opt5 from neuraminidase__InfluenzaA__ABO32659

SEQ ID NO: 198746 - RNA, 1410 nt, Artificial Sequence
  derived and/or modified sequence opt5 from neuraminidase__InfluenzaA__ABO32670
augaaccccaaucagaagaucauuaccaucggcagcgugucccugacaauuucuacgaucugcuucuuuaugcaaauugccauccucgucaccacaguuacccugcacuucaaacaguacgaguguaacagcccuccgaauaaccaggugaugcuuugcgaacccacaaucauugagagaaauaucaccgaaauuguguaucugacaaacaccacgaucgagaaggaaauuuguccuaaacucgcugaguaccggaauugguccaagccccagugcaacaucaccggguuugccccuuucucuaaagacaauagcauucgccuguccgcgggaggcgauaucugggucacaagagagcccuaugugucuugugacccugauaagugcuaccaauuugcucuugggcagggaaccacacugaacaauggccauagcaacgacaccguucacgaucggacgccguaucgcacacuccugaugaaugaacugggggugcccuuccauaugggaaccaagcaggucuguaucgccugguccucuagcuccugccacgacggcaaagccuggcuccauguguguguuacaggcgaugacgagaacgcuaccgccagcuuuauuuacaaugggagacugguggauucuaucggauccuggagcaagaaaauucuucggacccaggaaucugagugcgucuguaucaacggcacaugcacgguggugaugaccgacggguccgcuagcggaaaggccgauacaaaaauucuguucaucgaggaaggcaagaucguccacaccuccacacucucugggagcgcgcaacacguugaggaaugcuccuguuauccucgcuaccccggagugagaugcgugugucgggacaacuggaagggcagcaaucgcccuauugucgauaucaacauuaaagacuacucuaucguguccagcuauguuugcucuggccuggugggggacacccccagaaagaaugauagcuccucuagcucccauugucuugacccgaacaaugaggaaggaggccacggggucaaaggaugggccuuugaugacggcaacgauguguggauggggcggacgauuagcgagaagcugcgcucuggauacgagacauucaaaguuaucgaaggcugguccaagccuaauagcaaacuccagaucaacagacaggugauugucgaccggggcaaucgcucuggguauuccggaaucuuuagcguggagggcaaguccugcauuaacagauguuucuacgucgaacugauccgggggagaaagcaggagaccgaagugcuguggaccucuaauagcauuguuguguuuugcggaacauccggcaccuaugggacaggcucuuggcccgauggagcugacaucaaccucaugccuauuuga

SEQ ID NO: 198747 - RNA, 1413 nt, Artificial Sequence; identical to SEQ ID NO: 198598
  derived and/or modified sequence opt5 from neuraminidase__InfluenzaA__ABO32681

SEQ ID NO: 198748 - RNA, 1410 nt, Artificial Sequence
  derived and/or modified sequence opt5 from neuraminidase__InfluenzaA__ABO32695
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugcagcgacccgaacaaugaggaaggcgggcacggagugaaaggcugggccuucgaugacgggaacgauguuuggaugggacggacgaucucugagaagcugcgcuccggcuacgagacauuuaaagugaucgaaggguggagcaauccuaacucuaagcuccagauuaauagacaggucaucguggaccggggaaaccgcuccggcuauagcggcauuuucuccgucgaggggaaaucuuguaucaauagaugcuuuuacguggaacugauucggggaagaaaggaggaaaccgagguucuguggaccagcaacuccaucguggucuucuguggcacaucugggaccuauggaacaggcagcuggcccgauggggcugacauuaaucucaugccuaucuga

SEQ ID NO: 198749 - RNA, 1410 nt, Artificial Sequence; identical to SEQ ID NO: 197754
  derived and/or modified sequence opt5 from neuraminidase__InfluenzaA__ABO32754

SEQ ID NO: 198750 - RNA, 1410 nt, Artificial Sequence; identical to SEQ ID NO: 197754
  derived and/or modified sequence opt5 from neuraminidase__InfluenzaA__ABO32765

SEQ ID NO: 198751 - RNA, 1410 nt, Artificial Sequence; identical to SEQ ID NO: 198626
  derived and/or modified sequence opt5 from neuraminidase__InfluenzaA__ABO32778

SEQ ID NO: 198752 - RNA, 1410 nt, Artificial Sequence
  derived and/or modified sequence opt5 from neuraminidase__InfluenzaA__ABO32793
augaaccccaaucagaagaucauuaccaucggcagcgugucccugacaauuucuacgaucugcuucuuuaugcaaauugucauccucaucaccacaguuacccugcacuucaaacaguacgaguuuaacagcccuccgaauaaccaggugaugcuuugugaacccacaauuaucgagagaaauauuaccgaaaucguguaucugacaaacaccacgauugagaaggaaaucugcccuaaacucgccgaguaccggaauugguccaagccccagugugacauuaccggguucgcuccuuuuucuaaagauaacagcauccgccuguccgccggaggcgacaucugggucacaagagagcccuaugugucuugcgauccugacaaguguuaccaauucgcgcuugggcagggaaccacacugaauaacguucauagcaaugauaccgugcacgaccggacgccguaucgcacacuccugaugaacgaacugggcguccccuuucaucucgggaccaaacaggugugcauugcuugguccucuagcuccugucacgauggaaaggccuggcugcauguuugcgugacaggcgacgauaagaaugccaccgcuagcuucaucuacaacggcagacuugucgacucuauuguguccuggagcaaagagauccugcggacccaggaaucugagugugugugcauuaaugggacauguacggucguuaugaccgauggauccgccagcggcaagacagacaccaaaauccucuuuaucgaggaagggaagauugugcacacauccacccugucuggaagcgcucaacacguggaggaaugcuccugcuauccucgcuaccccggcgucagaugugugugccgggauaacuggaaggggagcaaccgcccuaucguugacauuaauaucaaagacuacucuauuguguccagcuaugucuguucuggacuugugggcgauacgcccagaaagaacgacagcuccucuagcucccauugccuggauccgaauaacgaggaaggcgggcacggaguuaaaggcugggccuucgacgaugggaaugacguguggaugggacggacaaucagcgagaagcuccgcucuggcuacgagaccuuuaaagucaucgaagggugguccaacccuaauagcaagcugcagauuaacagacaggugaucgucgaucggggaaaucgcucuggcuauuccggcauuuucagcguggaggggaaauccuguaucaacagaugcuuuuacguugaacugauucggggaagaaaggaggaaaccgaggugcucuggacaucuaauagcaucgucguguucuguggcaccuccgggacauauggaacgggcucuuggcccgacggggcggauauuaaccugaugccuaucuga

SEQ ID NO: 198753 - RNA, 1410 nt, Artificial Sequence; identical to SEQ ID NO: 197351
  derived and/or modified sequence opt5 from neuraminidase__InfluenzaA__ABO32806

SEQ ID NO: 198754 - RNA, 1410 nt, Artificial Sequence; identical to SEQ ID NO: 197738
  derived and/or modified sequence opt5 from neuraminidase__InfluenzaA__ABO32819

SEQ ID NO: 198755 - RNA, 1410 nt, Artificial Sequence; identical to SEQ ID NO: 197370
  derived and/or modified sequence opt5 from neuraminidase__InfluenzaA__ABO32830

SEQ ID NO: 198756 - RNA, 1410 nt, Artificial Sequence; identical to SEQ ID NO: 197736
  derived and/or modified sequence opt5 from neuraminidase__InfluenzaA__ABO32841

SEQ ID NO: 198757 - RNA, 1410 nt, Artificial Sequence; identical to SEQ ID NO: 197736
  derived and/or modified sequence opt5 from neuraminidase__InfluenzaA__ABO32852

SEQ ID NO: 198758 - RNA, 1410 nt, Artificial Sequence; identical to SEQ ID NO: 197736
  derived and/or modified sequence opt5 from neuraminidase__InfluenzaA__ABO32863

SEQ ID NO: 198759 - RNA, 1410 nt, Artificial Sequence; identical to SEQ ID NO: 198730
  derived and/or modified sequence opt5 from neuraminidase__InfluenzaA__ABO32874

SEQ ID NO: 198760 - RNA, 1410 nt, Artificial Sequence; identical to SEQ ID NO: 198730
  derived and/or modified sequence opt5 from neuraminidase__InfluenzaA__ABO32885

SEQ ID NO: 198761 - RNA, 1410 nt, Artificial Sequence; identical to SEQ ID NO: 198731
  derived and/or modified sequence opt5 from neuraminidase__InfluenzaA__ABO32896

SEQ ID NO: 198762 - RNA, 1410 nt, Artificial Sequence; identical to SEQ ID NO: 198731
  derived and/or modified sequence opt5 from neuraminidase__InfluenzaA__ABO32907

SEQ ID NO: 198763 - RNA, 1410 nt, Artificial Sequence
  derived and/or modified sequence opt5 from neuraminidase__InfluenzaA__ABO32918
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuaaacucgcugaguaccggaauugguccaagccccaguguaacaucacaggguucgccccuuuuucuaaagacaauagcauucgccuguccgcgggaggcgauaucugggugaccagagagcccuaugucucuugcgacccugauaaguguuaccaauucgcucuugggcagggaacaacccugaacaaugugcauagcaacgacacgguucacgaucggacaccguaucgcacccuccugaugaaugaacugggcgugcccuuucaucucgggacaaagcaggucugcaucgccugguccucuagcuccugucacgacggaaaagccuggcugcaugugugcguuaccggcgaugacaagaacgcuaccgccagcuucauuuacaauggcagacuuguggauucuaucgucuccuggagcaaagagauucugcggacacaggaaucugagugugugugcaucaacgggacguguaccguggucaugacagacggauccgcuagcggcaaggccgauaccaaaauucucuuuaucgaggaagggaagaucguucacacauccacccugucuggaagcgcgcaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacgcccagaaagaaugauagcuccucuagcucccauugccuggacccgaacaaugaggaaggcgggcacggagugaaaggcugggccuucgaugacgggaacgauguuuggaugggacggacaauuagcgagaagcuccgcucuggcuacgagaccuuuaaagugaucgaagggugguccaauagcaacucuaagcugcagaccaauagacaggucaucguggaccggggaaaccgcuccggcuauagcggcauuuucuccgucgaggggaaaucuuguaucaauagaugcuuuuacguggaacugauucggggaagaaaggaggaaacagagguucucuggaccagcaacuccaucguggucuucuguggcacaucugggacguauggaaccggcagcuggccugauggggcugacauuaaucugaugcccaucuga

SEQ ID NO: 198764 - RNA, 1410 nt, Artificial Sequence; identical to SEQ ID NO: 198763
  derived and/or modified sequence opt5 from neuraminidase__InfluenzaA__ABO32929

SEQ ID NO: 198765 - RNA, 1410 nt, Artificial Sequence; identical to SEQ ID NO: 198763
  derived and/or modified sequence opt5 from neuraminidase__InfluenzaA__ABO32940

SEQ ID NO: 198766 - RNA, 1413 nt, Artificial Sequence
  derived and/or modified sequence opt5 from neuraminidase__InfluenzaA__ABO32951
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgggauaauuggcacgggagcaaccgccccugggucuccuucaaucagaaccuugacuaccaaauuggauauaucugcagcggcguuuuuggggauaauccuagacccaaagacggagagggcucuuguaacccugugacaguggauggcgccaauggggucaagggauucuccuacaaauauggcaacgggguguggauuggacggacgaaguccaaucgccugagaaaaggcuuugaaaugaucugggaccccaacggguggaccgacacagauucugacuucuccguuaagcaggauguggucgcgauuaccgacuggagcggcuacuccggaucuuuugugcagcauccggagcucacaggccuggauugcauccggccuuguuucuggguugaacuugugcgcgggcugcccagagagaauaccacgaucuggacaagcggauccucuauuagcuucugcggcgucaacuccgacaccgccaacuggagcuggccugauggggcugaacuccccuuuaccaucgacaaguga

SEQ ID NO: 198767 - RNA, 1413 nt, Artificial Sequence
  derived and/or modified sequence opt5 from neuraminidase__InfluenzaA__ABO32962
augaaccccaaucagaagaucauuaccaucggcagcauuuccaucgccauugggaucaucucucugaugcuccaaauuggaaacaucauuagcaucugggcuucccacucuauucagacaggcagcaaaaaucauacgggggugugcaaccagagaaucauuaccuacgaaaauuccacaugggucaaccacaccuauguuaauaucaacaauacaaacgugguggccggaaaggacaaaaccucugucacacuggcgggcaauagcucccuuuguagcaucucugggugggcuauuuacaccaaggauaacuccauccggauuggaagcaaaggcgacguguucguuauccgcgagccuuuuauuucuugcucccaucuggaguguagaacguucuuucucacccagggcgcccugcuuaaugauaagcacagcaacgggacagugaaggaccggucuccguaucgcgcccugauguccugcccccucggagaagcuccuagccccuacaauuccaaauucgagucugucgccuggagcgcuaacgccugucaugauggcaugggguggcugaccaucggaaucuccggcccugacaacggggcgguggccguucugaaguauaauggaauuaucacagaaaccauuaaaagcuggaagaaacaaauccucagaacgcaggagucugagugcgugugugucaacggcuccugcuuuacaauuaugaccgauggccccagcaauggggcugccucuuacaagaucuucaagaucaaaaagggaaaagugacaaagagcauugaacugaacgcuccuaauuuucacuaugaggaauguuccugcuacccggacaccggcaccgugaugugugucugccgggauaacuggcacgggucuaaucgccccuggguuagcuucaaccagaaucuugacuaccagaucggauauauuugcuccggcguguuuggggauaacccuagacccaaagacggagagggcagcuguaauccugugacagucgauggcgccaacggggugaagggauucucuuacaaauauggcaaugggguuuggaucggacggacgaaguccaaccgccugagaaagggcuuugagaugauuugggaccccaauggguggaccgacacagauagcgacuucucugugcggcaagaugucguggcgaucaccgacugguccggcuacagcggauccuuuguucagcauccggaacucacaggccuggauugcauucgcccuuguuucuggguggagcuugucagagggcugccccgggaaaacaccacgaucuggacaucuggaagcuccaucucuuucugcggcgugaacagcgacaccgccaauugguccuggccugauggggcugagcuccccuuuaccauugacaaauga

SEQ ID NO: 198768 - RNA, 1413 nt, Artificial Sequence; identical to SEQ ID NO: 197410
  derived and/or modified sequence opt5 from neuraminidase__InfluenzaA__ABO32973

SEQ ID NO: 198769 - RNA, 1413 nt, Artificial Sequence; identical to SEQ ID NO: 197975
  derived and/or modified sequence opt5 from neuraminidase__InfluenzaA__ABO32984

SEQ ID NO: 198770 - RNA, 1413 nt, Artificial Sequence; identical to SEQ ID NO: 197975
  derived and/or modified sequence opt5 from neuraminidase__InfluenzaA__ABO32995

SEQ ID NO: 198771 - RNA, 1413 nt, Artificial Sequence
  derived and/or modified sequence opt5 from neuraminidase__InfluenzaA__ABO33009
augaaccccaaucagaagaucauuaccaucggcagcauuugcauggccaucgggaugauuucccugauccuccaaaucggaaacauuaucucuauuugggugagccacuccauccagacaggcucucagaaucauacggggauuuguaaccagagaaucauuaccuacgagaauagcacaugggucaaccaaaccuauguuaauaucuccaacacaaaugugguggcuggaaaagacaccacaucuaugacccuggccggcaacagcucccuuugcccuauccgggggugggcgauuuacagcaaggauaauucuauccgcauuggauccaaaggcgacgucuucgugaucagagaaccguuuauuagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccaucggaauuuccggccccgacgauggggccgucgcggugcugaaguauaauggaaucauuacagaaaccaucaagagcuggcgcaaacagauucugagaacgcaggagucugaguguguuugcgugaacggcuccuguuuuacaaucaugaccgacggcccuagcgaugggccggccucuuaccggaucuucaagauugaaaaaggaaagaucacaaaaagcauugagcucgacgcucccaacucccauuaugaagagugcucuuguuacccugauaccggcaccgucaugugcgugugccgcgacaauuggcacgggagcaacagacccuggguguccuuuaaucaaaaccuggauuaccagaucggauauauuuguagcggcgucuucggggacaauccucggcccaaggacggaaagggcucuugcgauccgguuaacguggacggcgccgauggggugaaaggauuuuccuaccgcuauggcaauggggucuggaucggaagaacaaagagcaacucuucccggaaaggcuucgagaugauuugggacccuaauggguggacggauaccgacagcaacuuucuugugaagcaggauguuguggcuaugacagacugguccggcuacucuggcagcuucguccagcaccccgaacugaccggacucgauuguaugcgcccuugcuuuuggguggagcugaucagagggcggcccagagagaaaacaaccaucuggacguccggaucuagcauuuccuucuguggcguuaauagcgacacagugaacuggucuuggcccgauggggccgaacuuccuuucaccaucgacaaguga

SEQ ID NO: 198772 - RNA, 1410 nt, Artificial Sequence; identical to SEQ ID NO: 198542
  derived and/or modified sequence opt5 from neuraminidase__InfluenzaA__ABO33039

SEQ ID NO: 198773 - RNA, 1410 nt, Artificial Sequence
  derived and/or modified sequence opt5 from neuraminidase__InfluenzaA__ABO33050
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaagcugcgcagcggauacgagacguuuaaagugauugaaggcuggucuaagcccaauuccaaacugcagaucaacagacaggucaucguggaccggggcaaucgcagcggguauucuggaauuuucuccgucgagggcaagagcugcaucaacagauguuuuuacguggaacucauucgggggagaaagcaggagacagaaguucuguggaccuccaauucuaucguggucuucugcggaaccagcggcacauaugggaccggcuccuggccugauggagccgacauuaaccuuaugcccaucuga

SEQ ID NO: 198774 - RNA, 1410 nt, Artificial Sequence; identical to SEQ ID NO: 197754
  derived and/or modified sequence opt5 from neuraminidase__InfluenzaA__ABO33061

SEQ ID NO: 198775 - RNA, 1410 nt, Artificial Sequence
  derived and/or modified sequence opt5 from neuraminidase__InfluenzaA__ABO33072
augaaccccaaucagaagaucauuaccaucggcagcgugucccugacaauugccacgaucugcuuccucaugcaaauugcuauccuggucaccacaguuacccuucacuuuaaacaguacgagugugggucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggauucgcgccuuuuuccaaggacaauucuauccgccugagcgcuggcggggauaucugggugaccagagagcccuauguuuccugugacccuggaaagugcuaccaauucgcccuuggccaggggacaacccuggauaacaaacauucuaaugacacaauucacgaucggaccccgcaucgcacgcuccugaugaacgaacugggagugcccuuucaccucggcacaagacaggucuguaucgccuggagcuccagcucuugccaugacggcaaggcuuggcugcacguguguguuaccggguaugauaaaaaugccacagcuuccuucauuuacgacggacggcuuguggauagcaucggcucuugguccaagaacauucugcgcacccaggagagcgaaugcgucuguaucaaugggaccugcacaguggugaugacggacggaucugccuccgagagagcggauaccaaaauccucuuuauugaggaaggcaagaucguccacauuagcccucuguccgggucugcccaacauguugaggaaugcagcuguuauccccgguacccuggagugcgcugcguguguagagacaacuggaagggcuccaaucggcccgucguggauaucaacguuaaagacuacagcauugugucuuccuaugucugcagcggccuugugggggacacaccgcgcaagaacgauagaucuagcuccucuuacugucggaauccuaacaaugagaaaggaaaccacggcguuaaggggugggcuuucgacgauggaaaugacguguggaugggccgcaccaucagcgaagaguccagaagcggguaugagacauuuaaagucaucggaggcuggucuacccccaacuccaagcugcagauuaauagacaggugaucgucgauagcgacaaccggucuggcuacuccgggauuuucagcguggaaggaaaauccugcaucaaucgcuguuuuuauguugagcucauucggggcagagaacaggagacgcgcgugugguggacaucuaacagcaucgucguguucugcgggaccuccggaaccuacggcacagggucuuggccugauggcgccgacauuaaucugaugcccaucuga

SEQ ID NO: 198776 - RNA, 1413 nt, Artificial Sequence; identical to SEQ ID NO: 198083
  derived and/or modified sequence opt5 from neuraminidase__InfluenzaA__ABO37991

SEQ ID NO: 198777 - RNA, 1413 nt, Artificial Sequence
  derived and/or modified sequence opt5 from neuraminidase__InfluenzaA__ABO38013
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaauggcucuugcuuuacaaucaugaccgauggcccuuccaacggggcugccagcuaccggauuuucaagaucgaaaaaggacgcguuacaaagucuauugagcuugacgcuccgaauuaucauuacgaagaguguagcugcuaccccgauaccggcaccgugaugugugucugcagagacaacuggcacggguccaaucggccuugggugucuuuuaaccagaaucuggauuaucaaaucggauacauuugcagcggcguguucggggacaacccccgcccuaaggauggagagggcuccuguaaucccgucacaguugacggcgccgacggggugaaaggauuuagcuauagauacggcaacgggguguggaucggacggacgaagucuaaucgccucagaaaaggcuaugaaaugauuugggauccgaacggguggaccgacacagauuccgacuucagcaugaagcaggauaucgucgcgaugaccgacuggucuggcuacuccggauccuuugugcagcacccugagcugacaggccuugauugcaugcggcccuguuucuggguugaacuggugagagggcucccucgcgagaauaccacgaucuggacauccggaucuagcauuuccuuuugcggcgucaacucugacaccgccaauuggagcuggcccgauggggcugaacugcccuucaccaucgacaaauga

SEQ ID NO: 198778 - RNA, 1413 nt, Artificial Sequence
  derived and/or modified sequence opt5 from neuraminidase__InfluenzaA__ABO38024
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauauuguugccggaaaagacaagaccuccgugacacuggcgggcaacucuagccuuuguuccaucagcgggugggcuauuuacaccaaagauaauucuauccggauuggauccaagggcgacguguucgucauccgcgaaccuuuuaucagcugcucucaucuggaguguagaacguucuuucucacccaaggcgcccugcuuaacgauaaacacuccaaugggacagugaaggaccggagcccguaucgcgcccugaugucuugcccccucggagaagcuccuucccccuacaacagcaaguucgaguccguugccuggucugcuagcgccugucaugauggcaugggguggcugaccauuggaaucuccggcccugacaacggggcgguggccguccugaaauauaauggaauuaucacagaaaccauuaagagcuggaaaaagagaauccuccggacgcaggagucugagugcguguguguuaacggcuccugcuuuacaaucaugaccgauggccccagcaauggggcugccucuuacaaaauuuucaagaucgaaaagggaaaagugacaaagagcauugagcugaacgcuccuaauuuucacuaugaagaguguuccugcuacccggacaccggcaccgucaugugugugugccgcgauaacuggcacgggucuaauagacccugggugagcuucaaccagaaucuugacuaccagaucggauauauuugcuccggcgucuuuggggauaacccucggcccaaagacggagagggcagcuguaauccuguuacaguggauggcgccgacggggugaagggauucucuuacaaauauggcaacggggucuggaucggacgcacgaaguccaauagacugcggaaaggcuuugaaauggugugggaccccaacggguggaccgauacagacagcgauuucucuguuaagcaagacguggucgcgauuaccgauugguccggcuacagcggauccuuugugcagcauccggagcucacaggccuggacugcauccgcccuuguuucuggguugaacuugugagagggcugccccgggagaauaccacgaucuggacaucuggaagcuccauuucuuucugcggcgucaacagcgauaccgccaacugguccuggccugacggggcugaacuccccuuuaccaucgauaaguga

SEQ ID NO: 198779 - RNA, 1413 nt, Artificial Sequence
  derived and/or modified sequence opt5 from neuraminidase__InfluenzaA__ABO38035
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaccugcaaccagagaaucauuacauacgaaaauuccaccugggugaaccacacauaugugaauaucaacaauaccaacguuguggccggaaaagacaagacaucugugacccuggcgggcaauagcucccuuuguagcaucucugggugggcuauuuacacgaaagauaacuccauccggauuggaagcaagggcgacgucuucgugauccgcgagccuuuuauuucuugcucccaucuggaguguagaaccuucuuucucacacaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaaucggaaucagcggcccugacaacggggcggucgccgugcugaaauauaacggaauuaucaccgaaacgauuaagucuuggaaaaagagaauccuccggacacaggaguccgagugcguuugugugaauggcagcugcuuuaccauuaugacagauggccccucuaacggggcugccagcuacaaaaucuucaagaucgaaaagggaaaagucaccaaguccauugagcugaaugcuccuaacuuucacuaugaagaguguucuugcuacccggacaccggcacagugaugugugugugccgcgauaauuggcacgggagcaacagacccugggucuccuucaaucagaaccuugacuaccagaucggauauauuugcagcggcguuuuuggggauaauccucggcccaaagacggagagggcucuuguaacccugugacgguggauggcgccgacggggucaagggauucuccuacaaauauggcaaugggguguggaucggacgcaccaagagcaacagacugcggaaaggcuuugaaguuauuugggaccccaauggguggacagauaccgacucugauuucuccgugaagcaagacgucguggcgaucacagauuggagcggcuacuccggaucuuuuguucagcauccggagcucaccggccuggacugcauucgcccuuguuucuggguggaacuugucagagggaugccccgggagaacacgacaaucuggaccagcggauccucuaucagcuucugcggcgucaauuccgauaccgccaacuggagcuggccugacggggcugaacugcccuuuacaauugauaaguga

SEQ ID NO: 198780 - RNA, 1413 nt, Artificial Sequence; identical to SEQ ID NO: 197420
  derived and/or modified sequence opt5 from neuraminidase__InfluenzaA__ABO38046

SEQ ID NO: 198781 - RNA, 1413 nt, Artificial Sequence; identical to SEQ ID NO: 197975
  derived and/or modified sequence opt5 from neuraminidase__InfluenzaA__ABO38068

SEQ ID NO: 198782 - RNA, 1410 nt, Artificial Sequence; identical to SEQ ID NO: 197351
  derived and/or modified sequence opt5 from neuraminidase__InfluenzaA__ABO38079

SEQ ID NO: 198783 - RNA, 1410 nt, Artificial Sequence
  derived and/or modified sequence opt5 from neuraminidase__InfluenzaA__ABO38090
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaacggacgccguaucgcacacugcugaugaaugagcucggggugcccuuucaucugggaaccaagcaggucuguaucgccuggagcuccagcucuugccacgauggcaaagccuggcuucauguguguguuacaggcgacgaugaaaacgcuaccgcuuccuucauuuacaaugggagacugguggacagcaucggaucuugguccaagaaaauucuccggacccaggagagcgagugcgucuguaucaacggcacaugcacgguggugaugaccgaugggucugccuccggaaaggcggacacaaaaauucuguuuaucgaagagggcaagaucguccacaccagccuucuguccgggucugcccaacacguugaagagugcagcuguuauccucgcuaccccggagugagaugcgugugucgggauaacuggaagggcuccaaucgcccuauugucgacaucaacgugaaagauuacagcauuguuucuuccuaugugugcagcggccucgucggggacacacccagaaagaaugacucuagcuccucuagccauugucuggauccgaacaaugaagagggaggccacggggugaaaggaugggcuuucgacgauggcaacgacguuuggauggggcggaccaucuccgagaagcugcgcagcggauacgaaacguuuaaagugauugagggcuggucuaagccuaauuccaaacuccagaucaacagacaggucaucguggaucggggcaaucgcagcggguauucuggaauuuucuccgucgaaggcaagagcugcaucaacagauguuuuuacguggagcugauucgggggagaaagcaggaaacagagguucuuuggaccuccaauucuaucguggucuucugcggaaccagcggcacauaugggaccggcuccuggcccgacggagccgauauuaaccugaugccuaucuga

SEQ ID NO: 198784 - RNA, 1410 nt, Artificial Sequence
  derived and/or modified sequence opt5 from neuraminidase__InfluenzaA__ABO38101
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccauuaauaaggacucccggagcggguacgaaacauuuaaggugaucggaggcuggucuaccccuaacuccaaaagccagguuaauagacaagugauugucgauaacaauaacuggucuggcuauuccgggaucuucagcguggagggaaaguccugcauuaaucgcuguuuuuacgucgagcuuauccggggcagaccccaggaaacacgcgugugguggaccucuaacagcauuguuguguucugcgggacguccggaacauauggcaccgggucuuggcccgacggcgcuaauaucaacuuuaugccuaucuga

SEQ ID NO: 198785 - RNA, 1410 nt, Artificial Sequence
  derived and/or modified sequence opt5 from neuraminidase__InfluenzaA__ABO38233
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuugguccaagaacauucugcgcacccaggagagcgaaugcgucuguaucaaugggaccugcacaguggugaugacggauggcucugccuccgagagagcggacaccaaaauccucuuuauugaggaaggaaagaucguccacauuagcccucuguccggcucugcccaacauguugaggaaugcagcuguuauccccgguacccuggggugcgcugcguguguagagauaacuggaagggauccaaucggcccgucguggacaucaacguuaaagacuacagcauugcuucuuccuaugugugcagcggccuugucggcgauacaccgcgcaagaacgacagauacucuagcuccuauugucggaauccuaacaaugagaaagggaaccacggagugaagggcugggccuucgaugacgggaaugauguuuggaugggacgcaccaucucugacgaaagcagauccggcuacgagacauuuaaagugaucgggggauggagcacccccaacucuaagcugcagauuaaucggcaggucaucguggauuccgacaacagaagcggcuauucuggcauuuucuccgucgaggggaaaagcugcaucaaucgcuguuuuuacguggaacucauucggggaagagagcaggaaacgcgcguuugguggacauccaacucuaucguggucuucugcggcaccagcgggaccuauggaacaggcuccuggccugauggggcugacauuaaucugaugcccaucuga

SEQ ID NO: 198786 - RNA, 1410 nt, Artificial Sequence; identical to SEQ ID NO: 198135
  derived and/or modified sequence opt5 from neuraminidase__InfluenzaA__ABO38244

SEQ ID NO: 198787 - RNA, 1410 nt, Artificial Sequence; identical to SEQ ID NO: 197351
  derived and/or modified sequence opt5 from neuraminidase__InfluenzaA__ABO38255

SEQ ID NO: 198788 - RNA, 1410 nt, Artificial Sequence; identical to SEQ ID NO: 197736
  derived and/or modified sequence opt5 from neuraminidase__InfluenzaA__ABO38277

SEQ ID NO: 198789 - RNA, 1410 nt, Artificial Sequence; identical to SEQ ID NO: 198763
  derived and/or modified sequence opt5 from neuraminidase__InfluenzaA__ABO38288

SEQ ID NO: 198790 - RNA, 1410 nt, Artificial Sequence
  derived and/or modified sequence opt5 from neuraminidase__InfluenzaA__ABO38299
augaaccccaaucagaagaucauuaccaucggcagcgugucccugacaauugccacggucugcuucaucaugcaaauugcuauccucgccaccacaguuacccugcacuuuaaacagcaugagugugacucuccugcgagcaaccaggugaugccgugcgaacccaucauuaucgagagaaauauuacagaaaucguguaccuuaacaauaccacaauugagaaggaaaucuguccugaggcugucgaguaucggaacugguccaaaccccagugccaaauuaccggguucgccccuuuuucuaaggauaauagcauccgccuguccgccggaggcgacaucugggugacgagagaacccuacguuucuugugauccugggaaaugcuaucaguucgcucucggacagggcaccacacuggacaacaagcacagcaaugggaccauucaugaucggaucccgcaccgcacacuucugaugaacgagcucggagugcccuuucaucugggcaccaagcaggucuguguggccugguccucuagcuccugccacgacggcaaggcuuggcugcacguuugugugacgggggaugacagaaaugccacagcgagcuucauuuacgauggacggcucgucgacucuaucggcuccuggagccaaaacauucugcgcacccaggaaucugagugcguguguaucaaugggacaugcaccguggucaugaccgauggauccgccagcggcagagcugacacacggauccuuuuuauuaaagaggggaaaaucguucauauuuccccucugucuggaagcgcccagcacguggaagagugcuccuguuauccccgcuacccugaugugagaugcacgugucgggacaacuggaagggcagcaaucgccccgucaucgacauuaacauggaagauuauucuaucgacuccagcuacgugugcucuggccucguuggggauaccccgagaaacgacgauagcuccucuaauagcaacugucgggacccuaauaacgagcgcggaaaucccggcgugaaagggugggcuuucgauaacggagacgaugucuggaugggcagaacaaucaauaaggacucccggagcggguacgaaaccuuuaaggugauuggaggcuggucuacaccuaacuccaaaagccagguuaauagacaagugaucgucgauaacaauaacuggucuggcuauuccgggauuuucagcguggagggaaaguccugcaucaaucgcuguuuuuacgucgagcugauucggggcagaccccaggaaacccgcgugugguggacgucuaacagcaucguuguguucugcgggacauccggaaccuauggcaccgggucuuggcccgacggcgccaauauuaacuuuaugccuaucuga

SEQ ID NO: 198791 - RNA, 1410 nt, Artificial Sequence
  derived and/or modified sequence opt5 from neuraminidase__InfluenzaA__ABO38310
augaaccccaaucagaagaucauuaccaucggcagcgugucccugacaauugccacggucugcuuccucaugcaaaucgcuauucuggccaccacaguuacccuucacuuuaaacagcaugagugugacucuccuacaagcaaccaggugaugccgugcgaacccaucaucauugagagaaauaucaccgaaauuguguaccugaacaauacaaccaucgagaaggaaauuuguccugaggucguggaguaucggaacugguccaaaccccagugccaaaucacgggguucgcgccuuuuucuaaggauaauagcauucgccucuccgcuggaggcgacaucuggguuaccagagaacccuacgugucuugugauccugggaaaugcuaucaguucgcccugggacagggcacaacccuugacaacaagcacagcaaugggacaauccaugaucggauuccgcaccgcacccugcucaugaacgagcugggaguccccuuucaucugggcacgaaacagguguguguugccugguccucuagcuccugccacgacggcaaggcuuggcuccacgugugugucacaggggaugacagaaaugccaccgcuagcuucaucuacgauggacggcugguggacucuauuggcuccuggagccaaaacauccuucgcacacaggaaucugagugcguguguauuaaugggaccugcaccgucguuaugacagauggauccgccagcggcagagcggacacgcggauccuguuuaucaaggaggggaaaauugugcauaucuccccucucucuggaagcgcccagcacauugaagagugcuccuguuauccccgcuacccugaugugagaugcaucugucgggacaacuggaagggcagcaaucgccccgucauugacaucaacauggaagauuauucuaucgacuccagcuacgugugcucuggccugguuggggauaccccgagaaacggagacagcuccucuaauagcaacugucgggauccuaauaacgagcgcggcaaucccggggugaaaggaugggcuuucgacaacggcgaugacgucuggauggggagaacaauuaauaaggaaucccggagcggauacgagaccuuuaaggugaucggcggcuggucuacaccuaacuccaaaagccagguuaauagacaagugauugucgauaacaauaacuggucuggguauuccggaaucuucagcguggagggcaaguccugcauuaaucgcuguuuuuacgucgaacuuauccgggggagaccccaggagacccgcgugugguggacgucuaacagcauuguuguguucugcggaacauccggcaccuaugggaccggcucuuggcccgacggagccaauaucaacuuuaugccuaucuga

SEQ ID NO: 198792 - RNA, 1413 nt, Artificial Sequence; identical to SEQ ID NO: 197954
  derived and/or modified sequence opt5 from neuraminidase__InfluenzaA__ABO38332

SEQ ID NO: 198793 - RNA, 1413 nt, Artificial Sequence
  derived and/or modified sequence opt5 from neuraminidase__InfluenzaA__ABO38343
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagcuaccgcauuuucaagaucgaaaaaggaaagauuaccaaaucuaucgagcucgaugcccccaacagccauuaugaagagugcuccuguuacccugacaccggcacagugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugacgguggauggcgcugacggggucaaaggauuuucuuacagauauggcaacgggguguggauuggacggaccaaguccaauagcucucgcaaaggcuucgagaugaucugggauccuaacggguggacagacaccgauuccaauuuucuuguuaagcaggacguggucgccaugacagauuggagcggcuacuccggaucuuucgugcagcaccccgaacugaccggccucgacuguaugagaccuugcuuuuggguugagcuggugcgggggagaccccgcgaaggaacgacagucuggaccagcggcuccucuaucagcuucuguggggugaacuccgauaccgcuaauuggagcuggcccgacggagccgagcuuccuuucacaauugauaaauga

SEQ ID NO: 198794 - RNA, 1410 nt, Artificial Sequence
  derived and/or modified sequence opt5 from neuraminidase__InfluenzaA__ABO38354
augaaccccaaucagaagaucauuaccaucggcagcauuugcaugguggucgggaucauuucccugauccuccaaaucggaaacauuaucucuauuuggaucagccacuccauucagacaggcucucagaaucauacggggaucuguaaccagaauauuaucaccuacaaaaacagcacauggguuaaucaaaccuaugugaacaucuccaauacaaacguggucgccggacaggacaccacaucugugauucugaccggcaauagcucccuuugcccuaucagagggugggcuauuuacagcaaggauaacucuauccggauuggauccaaaggcgacguuuucgugauccgcgagccguuuaucagcuguucucaccuggaaugcagaacguucuuucucacccagggcgcccugcuuaaugaucggcauuccaacgggacagucaaggaccgcagccccuauagagcgcugaugucuuguccugugggagaggcucccuccccuuacaauagccgguucgaauccguugccuggucugccagcgcuugccacgauggcaugggguggcucaccauuggaaucuccggccccgacaacggggccguggcuguccugaaauauaacggaauuaucacagagaccauuaagagcuggcgcaagaaaauccugagaacgcaggaaucugagugugccugcgugaauggcuccuguuuuacaaucaugaccgauggcccuagcaacgggcucgcgucuuacaagauuuucaaaaucgagaagggaaaagugacaaagagcauugaacugaaugccccgaacucccauuaugaggaaugcucuuguuaccccgacaccggcaaggucaugugcguuugccgggauaauuggcacgggagcaaccgcccuuggguguccuuugaccaaaaucuugauuaccagaucggauauauuuguagcggcguguucggggacaaccccagaccuaaagauggaaccggcucuugcggccccgucuacguggacggggcuaauggaguuaagggcuuuuccuaucgguacgggaacggaguguggaucggccgcacaaaaagcaauucuuccagacacggguucgagaugauuugggacccgaacggcuggacggagaccgauagcaaguuuuccguccggcaggacgugguugccaugacagauuggucuggauauagcggcuccuucgugcagcauccugaacugaccgggcucgacuguaugcgccccugcuuuugggucgagcugaucagaggacggccuaaagaaaauacaaucuggaccucuggcagcuccauuagcuucuguggggugaacucugauacggucgacugguccuggcccgauggagcugagcuucccuucacaaucgacaaguga

SEQ ID NO: 198795 - RNA, 1413 nt, Artificial Sequence
  derived and/or modified sequence opt5 from neuraminidase__InfluenzaA__ABO38365
augaaccccaaucagaagaucauuaccaucggcagcauuugcauggccaucgggauuaucucccugauccuccaaaugggaaacauuaucucuauuugggugagccacuccauccagacaggcucucagaaucauacggggauuuguaaccagagaaucauuaccuacgagaauagcacaugggucaaccaaaccuauguuaauaucaacaauacaaacgugguggcuggaaaagacaccacauccgucacccuggccggcaauucuagccuuugcccuauccgggggugggcgauuuacuccaaggauaacagcauccgcauuggaucuaaaggcgacguguucguuaucagagaaccguuuauuuccuguagccaccuggagugccggacguucuuucucacccagggcgcucugcuuaaugauaagcauucuaacgggacagugaaagaccgcucccccuauagagcccugaugagcuguccuaucggagaagcccccucuccuuacaauucccgguucgagagcgucgcuugguccgccucugcuugccacgauggcaugggguggcucaccaucggaauuagcggccccgacgauggggccguggcgguucugaaguauaacggaaucauuacagaaaccaucaaguccuggcgcaaacggauucugagaacgcaggagagcgagugugugugcgucaacggcucuuguuuuacaaucaugaccgacggcccuuccaaugggccggccagcuaccgcaucuucaagauugaaaaaggaaagaucacaaaaucuauugagcucgaugcucccaacagccauuaugaagagugcuccuguuacccugacaccggcaccgugaugugcgugugcagagauaauuggcacgggucuaaccggcccugggucagcuuuaaucagaaccuggacuaccaaaucggauauauuuguuccggcguuuucggggauaauccucgccccaaggacggaaagggcagcugcgacccggugacaguggauggcgccgacggggucaaaggauuuucuuacagauauggcaacgggguguggaucggacggacgaaguccaauagcucucgcaaaggcuucgagaugauuugggauccuaacggguggaccgacacagauuccaauuuucuuguuaagcaggacguggucgcuaugaccgauuggagcggcuacuccggaucuuucgugcagcaccccgaacugacaggccucgacuguaugagaccuugcuuuuggguugagcugauccgggggagaccccgcgagaaaaccacgaucuggacaagcggauccucuauuagcuucuguggcgugaacuccgauaccgccaauuggagcuggcccgacggggcggaacuuccuuucaccaucgauaaguga

SEQ ID NO: 198796 - RNA, 1410 nt, Artificial Sequence
  derived and/or modified sequence opt5 from neuraminidase__InfluenzaA__ABO38376
augaaccccaaucagaagaucauuaccaucggcagcauuugcaugguggucgggaucauuucccugauccuccaaaucggaaacauuaucucuauuuggaucagccacuccauucagacaggcucucagaaucauacggggaccuguaaccagagcaucauuacauacaaaaauuccaccuggguuaaccaaacauaugugaauaucucuaacaccaauguggucgccggaaaggacacaaccagcgugauccuggcuggcaacuccagccuuugcccuauuagagggugggccaucuacucuaaagauaauggaguucggauuggcuccaagggcgacguguucgucauccgcgagccguuuauuagcuguucucaccuggaaugcagaacguucuuucucacccagggggcgcugcuuaacgauaaacauuccaauggaacagugaaggaccggagccccuaucgcgcucugaugucuuguccuguuggcgaggcccccuccccuuacaacagcagauucgaauccguggccuggucugcuagcgccugccacgaugggaugggauggcucaccaucggcaucuccgggcccgacgauggagcugucgccgugcugaaguauaauggcauuaucacagagaccauuaaaagcuggcggaaggaaauccugcgcacgcaggagucugagugugcgugcgugaacggcuccuguuuuacaauuaugaccgacgggccuagcggaggcccggccucuuacaaaaucuucaagaucgaaaaagggaaggucacaaagagcauugagcucgaugcucccaacucccauuaugaagagugcucuuguuacccugacaccggaaaaguuaugugcgugugcagagauaauuggcacggcagcaaccggcccuggguguccuuugaccagaaucuggauuaccaaaugggguauaucuguagcggagucuucggcgacaacccucgccccaaggacggcaaagggaauugcggaccgguguacguugauggcgccaacggggugaagggauuuucuuauagauacggcaauggggucuggauuggccggaccaaauccaacagcucucgccagggauucgagaugaucugggacccuaauggcuggacagaaacggauuccaacuuuuucgugaagcaggacguuguggcugucaccgauuggagcggguauuccggaucuuuugugcagcaccccgagcuuacaggccuggacuguaugagaccuugcuucugggucgaacucauucgggggcgccccaaagagaagaccaucuggacaagcggauccucuauuagcuucuguggcguuaauuccgauaccguggacuggagcuggcccgauggggccgaacugccuuuuacgaucgacaaguga

SEQ ID NO: 198797 - RNA, 1410 nt, Artificial Sequence
  derived and/or modified sequence opt5 from neuraminidase__InfluenzaA__ABO38387
augaaccccaaucagaagaucauuaccaucggcagcauuugcaugguggucgggaucauuucccugauccuccaaaucggaaacauuaucucuauuuggaucagccacuccauucagacaggcucucagaaucauacggggaucuguaaccagagcauuaucaccuacaaaaauuccacauggguuaaccaaaccuaugugaauaucucuaacacaaauguggucgccggacaggacaccacaagcgugauucugaccggcaacuccagccuuugcccuaucagagggugggcuauuuacucuaaggauaauggaauccggauuggcuccaaaggcgacguuuucgugauccgcgagccguuuaucagcuguucucaccuggaaugcagaacguucuuucucacccagggggcccugcuuaacgauaagcauuccaauggaacagucaaagaccggagccccuaucgcgcgcugaugucuuguccugugggcgaggcucccuccccuuacaacagcagauucgaauccguugccuggucugccagcgcuugccacgaugggaugggauggcucaccauuggcaucuccgggcccgacaaugaggccguggcuguccugaaguauaacggaauuaucacagaaaccauuaagagcuggcggaaaaagauccugcgcacgcaggagucugagugugccugcgugaacggcuccuguuuuacaaucaugaccgauggcccuagcgacgggcucgcgucuuacaaaauuuucaagaucgaaaaaggaaaggugacaaagagcauugagcugaaugccccgaacucccauuaugaagagugcucuuguuaccccgauaccggcaaagucaugugcguuugcagagacaauuggcacgggagcaaccggccuuggguguccuuugaucaaaaucuugacuaccagaucggauauauuuguagcggcguguucggggauaacccccgcccuaaggacggaaccggcucuugcggccccgucuacguggacggggcuaauggaguuaaaggcuuuuccuauagauacgggaacggaguguggaucggccggacaaagagcacgucuucccgccacggguucgagaugauuugggauccgaauggcuggaccgaaacagacagcaaauuuuccgucagacaggaugugguugccaugaccgacuggucuggauauagcggcuccuucgugcagcauccugagcugacagggcucgauuguaugcggcccugcuuuugggucgaacugauccgcggacaaccuaaggagaaaaccaucuggacgucuggcagcuccauuagcuucuguggggugaacucugacacagucgauugguccuggcccgacggagcugaacuucccuucaccaucgauaaguga

SEQ ID NO: 198798 - RNA, 1413 nt, Artificial Sequence
  derived and/or modified sequence opt5 from neuraminidase__InfluenzaA__ABO38398
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaauuucuuucucacccagggcgcccugcuuaacgauaaacacuccaaugggacggugaaggaccggagccccuaccgcgcccugaugucuuguccuaucggagaagcucccuccccuuauaacagcagauucgaguccgucgccuggucugcuagcgccugccaugauggcaugggguggcucaccauuggaaucuccggccccgacgauggggcgguggccguucugaaauacaacggaauuaucacagaaaccauuaagagcuggcggaagcgcauccugagaacacaggagucugagugugugugcgucaauggcuccuguuuuaccaucaugacggacggcccuaacaaugggccggcuagcuauaaaauuuucaagaucgaaaaaggaaagauuacaaaaucuaucgagcucgaugcccccaacagccacuacgaagagugcuccuguuacccugacgcuggcaccgugaugugcgugugccgggauaauuggcaugggucuaaccgccccugggucagcuuuaaucaaaaccuggacuaucagauuggauacaucuguuccggcguuuucggggauaauccuagacccaaggacggaaagggcagcugcgacccggugacaguggauggcgccgacggggucaaaggauuuucuuaucgguacggcaacgggguguggauuggacgcaccaaguccaauagcucuagacggggcuucgagaugaucugggauccuaacggguggaccgacacagauuccaaauuucuuguuaagcaggacguggucgcgaugacggauuggagcggcuauuccggaucuuucgugcagcaccccgaacugaccggccucgacuguaugcgcccuugcuuuuggguugagcugaucagagggcggcccagagaaaauacaaccauuuggacaagcggauccucuaucagcuucuguggcgugaacggggauaccgccaauugguccuggcccgacggagcugagcuuccuuucacgauugauaaauga

SEQ ID NO: 198799 - RNA, 1410 nt, Artificial Sequence; identical to SEQ ID NO: 197277
  derived and/or modified sequence opt5 from neuraminidase__InfluenzaA__ABO38420

SEQ ID NO: 198800 - RNA, 1410 nt, Artificial Sequence
  derived and/or modified sequence opt5 from neuraminidase__InfluenzaA__ABO38715
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaaccuguccuaaagugguugaguaucgguccuggucuaagccccagugcaaaauuacgggguucgcgccuuuuagcaaggauaacuccauccgccucucugcuggaggcgacauuugggugaccagagagcccuacgucagcugugauccugggaagugcuaucaauucgcccugggacagggcacaacccuugacaauaaacacuccaacgauacaauccaugaccggaucccgcaccgcacccugcucaugaaugaacugggggugcccuuucaucugggaacgagacagguuuguauugccuggucuagcuccagcugccacgauggcaaggcuuggcuccacgugugugucacaggcgacgauaaaaacgccaccgcuucuuucaucuacgacgggcggcugguggauuccauuggaagcuggucucagaauauccuucgcacacaagaguccgaaugcguguguauuaacggaaccugcaccgucguuaugacagacgggagcgccuccggcagagcggauacgcggauccuguuuaucgaggagggcaagauugugcauaucucuccucucagcggguccgcccagcacguggaagagugcagcuguuauccccgcuacccugacgucagaugcauuugucgggacaauuggaaaggaucuaaccgccccaucguggauauuaauauggaagacuauuccaucgauagcucuuacguuugcagcggccuggugggcgacaccccgagaaacgaugaccgguccucuaacagcaauugucgcaacccuaauaacgagagagggaaucagggagucaagggcugggcuuucgauaacggggacgauguguggaugggacggacaaucuccaaggaccuuagaagcggcuacgaaaccuuuaaaguuauugggggauggucuacacccaauuccaagagccagaucaaccgccaagugauugucgauucugacaaucgguccggcuauagcggcaucuucuccguggaggggaaaucuugcauuaacagauguuuuuacgucgagcugauccgcggacggaagcaggaaaccagagugugguggacgagcaauuccauuguuguguucugcggcacaucugggaccuauggaaccggcagcuggccugacggggccaacaucaauuuuaugcccaucuga

SEQ ID NO: 198801 - RNA, 1410 nt, Artificial Sequence; identical to SEQ ID NO: 198800
  derived and/or modified sequence opt5 from neuraminidase__InfluenzaA__ABO38726

SEQ ID NO: 198802 - RNA, 1413 nt, Artificial Sequence
  derived and/or modified sequence opt5 from neuraminidase__InfluenzaA__ABO44049
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugauuugugugugccgcgauaauuggcacgggagcaacagacccugggucuccuucaaucagaaccuugacuaccagaucggauauauuugcagcggcguuuuuggggauaauccucggcccaaagacggagagggcucuuguaacccugugacaguggauggcgccgacggggucaagggauucuccuacaaauauggcaaugggguguggaucggacgcacgaaguccaacagacugcggaaaggcuuugaaaugauuugggaccccaauggguggaccgauacagacucuaacuucuccguuaagcaagauguggucgcgaucaccgacuggagcggcuacuccggaucuuuugugcagcauccggagcucacaggccuggauugcauccgcccuuguuucuggguugaacuugugagagggcugccccgggagaauaccacgauuuggacaagcggauccucuaucagcuucugcggcgucaacuccgacaccgccaacuggagcuggccugauggggcugaacuccccuuuaccauugacaaguga

SEQ ID NO: 198803 - RNA, 1410 nt, Artificial Sequence
  derived and/or modified sequence opt5 from neuraminidase__InfluenzaA__ABO44060
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugcaaaaucaccggguucgcgccuuuuucuaaggauaauagcauucgccucuccgcuggaggcgacaucugggugacgagagagcccuacgucucuugugauccugggaagugcuaucaauucgcccugggacagggcaccacacuugacaacaaacacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacgugugugucacgggcgacgauaaaaaugccacagcuagcuucauuuacgacgggcggcugguggauucuaucggauccuggagccagaacauucuucgcacccaagagucugaaugcguguguaucaauggcacaugcaccgucguuaugaccgacggguccgccagcggcagagcggauacaaagauccuguuuauugaggagggaaaaaucgugcauauuuccccucucucugggagcgcccagcacguggaagagugcuccuguuauccccgguacccugacguccgcugcaucuguagagacaacuggaagggaagcaaucggcccgugguugauauuaacauggaagacuauucuaucgauuccagcuacgugugcucuggccuggucggcgacacgccgcgcaacgaugacagaagcuccaauucuaacugucggaauccuaacaaugagcgcgggaaccagggagugaagggcugggcuuucgauaauggggacgauguuuggaugggaagaaccaucagcaaagaccuucgguccggcuacgaaacauuuaaggugauugggggauggagcacccccaacucuaaaucccagaucaauagacaagucauuguggauagcgacaaccgcucuggcuauuccggcaucuucagcgucgaggggaaguccugcauuaaucgguguuuuuacguggagcugaucagaggacgcaaacaggaaacacggguuugguggaccucuaacagcauuguggucuucugcggcacguccgggacauauggaaccggcucuuggccugacggggccaauaucaaccucaugcccaucuga

SEQ ID NO: 198804 - RNA, 1410 nt, Artificial Sequence
  derived and/or modified sequence opt5 from neuraminidase__InfluenzaA__ABO44071
augaaccccaaucagaagaucauuaccaucggcuucguguuucugacaauugccacggucugcuuccucaugcaaaucgcuauucugguuaccacagugacccuucacuuuaaacaguacgagugugacagcccugccuccaaccaggugaugccgugcgaacccaucaucauugagagaaauaucacagaaauugucuaucugaacaauaccacaaucgagaaggaaauuuguccuaaagugguugaguaccggaacuggucuaagccccagugccaaaucaccggguucgcgccuuuuagcaaagauaauuccauucgccucucugcuggaggcgacaucugggugacgagagagcccuaugucagcugugaucaugggaagugcuaccaguucgcccugggacagggcaccacacuugacaacaagcacuccaaugauaccauccaugaccggauuccucaccgcacacugcucaugaacgaacugggggugccguuucaucugggaaccagacagguuuguaucgccuggucuagcuccagcugccacgauggcaaggcuuggcuccacguguguauuacgggcgacgauaaaaaugccacagcuucuuucaucuaugacgggcggcuggucgauuccauuggaagcuggucucaaaacauccuucgcacccaggaguccgaaugcguguguaucaauggcacaugcaccguggucaugaccgacgggagcgccucuggcagagcggauacacggauucuguuuaucgaggagggaaaaauuguucauaucagcccccucuccggguccgcccagcacguggaagagugcucuuguuacccucgcuaucccggagugagaugcauuugucgggacaacuggaagggcagcaaucgcccugucguggacaucaacauggaagauuacuccaucgacagcucuuacguuugcuccggccuggugggggauacgcccagaaacgacgaucggagcucuaauagcaacuguaaaaauccgaacaaugagcgcggaaaccagggcgucaaggggugggcuuucgacaauggagaugacguguggaugggcagaaccauuuccaaggaucuucggucuggguaugaaacauuuaaaguuaucggaggcuggagcaccccuaacuccaagagccaaauuaauagacaggugaucgucgacucugauaaccgcuccggcuacagcgggauuuucucuguggagggaaaauccugcaucaaucgguguuuuuaugucgagcugauuagaggccgcaagcaggaaacacgggugugguggaccagcaacuccaucguuguguucugcgggacgucuggaacauacggcaccgggagcuggcccgacggcgccaauaucaacuucaugccuauuuga

SEQ ID NO: 198805 - RNA, 1410 nt, Artificial Sequence; identical to SEQ ID NO: 197370
  derived and/or modified sequence opt5 from neuraminidase__InfluenzaA__ABO44082

SEQ ID NO: 198806 - RNA, 1410 nt, Artificial Sequence
  derived and/or modified sequence opt5 from neuraminidase__InfluenzaA__ABO44093
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucaucuacgauggacggcugguggacucuauuggcuccuggagccaaaacauccuucgcacccaggaaucugagugcguguguauuaaugggacaugcaccgucguuaugaccgauggauccgcgagcggcagagccgacacacggauccuguuuaucaaggaggggaaaauugugcauaucuccccucucucuggaagcgcucagcacauugaagagugcuccuguuauccccgcuacccugaugugagaugcaucugucgggacaacuggaagggcagcaaucgccccguccuggacauuucuauggaagauuauuccaucgacagcucuuacgugugcagcggccuuguuggggauacgccgagaaacgacgauuccucuagcaacuccaauugucgggacccuaacaaugagcgcggaaaccccggcgugaaagggugggccuucgauaauggagacgaugucuggaugggcagaaccaucagcaaggaccugcggucuggguacgaaacauuuaaggugauuggaggcugguccaccccuaacagcaaaucucagguuaauagacaagugaucgucgauaacaauaacugguccggcuauagcgggauuuucuccguggagggaaagucuugcaucaaucgcuguuuuuacgucgagcucauucggggcagaagccaggaaacacgcgugugguggaccuccaacucuaucguuguguucugcgggacgagcggaacauauggcaccggguccuggcccgacggcgcuaauauuaacuuuaugcccaucuga

SEQ ID NO: 198807 - RNA, 1410 nt, Artificial Sequence
  derived and/or modified sequence opt5 from neuraminidase__InfluenzaA__ABO44104
augaaccccaaucagaagaucauuaccaucggcagcgccucccugacaauugcuacggugugcuuccucaugcaaaucgccauucuggucaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccuaaagucguggaguaucggaacugguccaagccccagugcaaaaucaccggguucgcuccuuuuucuaaggauaauagcauucgccucuccgccggaggcgacaucuggguuacgagagagcccuacgugucuugugauccugggaagugcuaucaauucgcccugggacagggcaccacacuugacaacaaacacagcaaugauaccauccaugaccggauuccgcaccgcacacugcucaugaacgaacuggggguccccuuucaucugggaaccagacagguguguaucgcuugguccucuagcuccugccacgauggcaaggccuggcuccacguuugugugacgggcgacgauaaaaaugcuacagccagcuucauuuacgacgggcggcuggucgauucuaucggauccuggagccagaacauucuucgcacccaagagucugaaugcguguguaucaauggcacaugcaccguggucaugaccgacggguccgcgagcggcagagccgauacacggauccuguuuauugaggagggaaagaucguucauauuuccccucucucugggagcgcucagcacguggaagagugcuccuguuauccccgcuacccugacgugagaugcaucugucgggacaacuggaaaggaagcaaucgccccgucguggauauuaacauggaagacuauucuaucgauuccagcuacguuugcucuggccuggugggcgacacgccgagaaacgaugaccggagcuccaauucuaacugucgcaauccuaacaaugagaaggggaaccagggagucaagggcugggccuucgauaauggggacgauguguggaugggaagaaccaucagcaaagaccuucgguccggcuacgaaacauuuaagguuauugggggauggagcacccccaacucuaaaucccagaucaauagacaagugauugucgauagcgacaaccgcucuggcuauuccggcaucuucagcguggaggggaaguccugcauuaaucgguguuuuuacgucgagcugaucagaggacgcaaacaggaaacacgggugugguggaccucuaacagcauuguuguguucugcggcacguccgggacauauggaaccggcucuuggccugacggggcuaauaucaaccucaugcccaucuga

SEQ ID NO: 198808 - RNA, 1413 nt, Artificial Sequence
  derived and/or modified sequence opt5 from neuraminidase__InfluenzaA__ABO44126
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcgcccugaugucuuguccuaucggagaagcucccuccccuuauaauagcagauucgaguccgucgccuggucugcuagcgccugccaugauggcaugggguggcucacaauuggaaucuccggccccgacgauggggcgguggccguucugaaauacaacggaauuaucaccgaaacaauuaagagcuggcggaagcgcauccugagaacccaggagucugagugugugugcgucaacggcuccuguuuuacgaucaugacagacggcccuaauaacgggccggcuagcuauaaaauuuucaagaucgaaaaaggaaagauuaccaaaucuaucgagcucaaugcccccaacagccacuacgaagagugcuccuguuacccugaugcuggcacagugaugugcgugugccgggacaauuggcaugggucuaaccgccccugggucagcuuuaaucaaaaccuggauuaucagauuggauacaucuguuccggcguuuucggggacaauccuagacccaaggauggaaagggcagcugcggcccggugaccguggacggggccgacggagucaaaggcuuuucuuaucgguacgggaacggaguguggauuggccgcaccaaguccaauagcucuagacggggguucgagaugaucugggauccuaacggcuggacagacacggauuccaaauuucuuguuaagcaggacguggucgcgaucaccgauuggagcggauauuccggcucuuucgugcagcaccccgaacugacagggcucgacuguaugcgcccuugcuuuuggguugagcugauuagaggacggcccagagaaaauaccacaaucuggaccagcggcuccucuauuagcuucuguggggugaacggagauacggccaauugguccuggcccgacggcgcugagcuuccuuucacaaucgauaaauga

SEQ ID NO: 198809 - RNA, 1413 nt, Artificial Sequence
  derived and/or modified sequence opt5 from neuraminidase__InfluenzaA__ABO52228
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgagaauagcacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagaaccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauuccaaguucgagagcguugccugguccgcuucugccugucacgauggccugggguggcugaccauuggaaucagcggccccgacaacggggcgguggccguccucaaauauaacggaauuaucacagaaaccauuaaguccuggaaaaagcggauccugcgcacgcaggagagcgagugcguguguaugaauggcucuugcuuuacaaucaugaccgauggcccuuccaacggggcugccagcuacagaauuuucaaaaucgaaaagggacggguuacaaagucuauugagcuugacgcuccgaauuaucauuacgaagaguguagcugcuaccccgauaccggcaccgugaugugugucugccgcgacaacuggcacggguccaauagaccuugggugucuuuuaaccagaaucuggauuaucaaaucggauacauuugcagcggcguguucggggacaacccccggccuaaagauggagagggcuccuguaaucccgucacaguugacggcgccgacggggugaagggauuuagcuaucgcuacggcaacgggguguggaucggaagaacgaaaucuaaucggcuccgcaagggcuucgaaaugauuugggauccgaacggguggaccgacacagauuccgacuuuagcaugaaacaggauaucgucgcgaugaccgacuggucuggcuauuccggauccuucgugcagcacccugagcugacaggccuugauugcaugagacccuguuuuuggguugaacuggugcgggggcucccuagagagaauaccacgaucuggacauccggaucuagcauuuccuucugcggcgucaacucugacaccgccaauuggagcuggcccgauggggcugaacugcccuucaccaucgacaaguga

SEQ ID NO: 198810 - RNA, 1410 nt, Artificial Sequence
  derived and/or modified sequence opt5 from neuraminidase__InfluenzaA__ABO52239
augaaccccaaucagaagaucauuaccaucggcagcgugucccugacaauugccacggucugcuucaucaugcaaauugcuauccucgccaccacaguuacccugcacuuuaaacagcaugagugugacucuccugcgagcaaccaggugaugccgugcgaacccaucauuaucgagagaaauauuacagaaaucguguaccuuaacaauaccacaauugagaaggaaaucuguccugaggcugucgaguaucggaacugguccaaaccccagugccaaauuaccggguucgccccuuuuucuaaggauaauagcauccgccuguccgccggaggcgacaucugggugacgagagaacccuacguuucuugugauccugggaaaugcuaucaguucgcucucggacagggcaccacacuggacaacaagcacagcaaugggaccauucaugaucggaucccgcaccgcacacuucugaugaacgagcucggagugcccuuucaucugggcaccaagcaggucuguguggccugguccucuagcuccugccacgacggcaaggcuuggcugcacguuugugugacgggggaugacaaaaaugccacagcgagcuucauuuacgauggaagacucgucgacucuaucggcuccuggagccaaaacauucugcggacccaggaaucugagugcguguguaucaaugggacaugcaccguggucaugaccgauggauccgccagcggccgcgcugacacaagaauccuuuuuauuaaagaggggaagaucguucauauuuccccucugucuggaagcgcccagcacguggaagagugcuccuguuauccccgguacccugaugugcgcugcaucuguagagacaacuggaaaggcagcaaucggcccgucauugacaucaacauggaagauuauucuaucgacuccagcuacgugugcucuggccucguuggggauacgccgcgcaacgacgauagcuccucuaauagcaacuguagagacccuaauaacgagcggggaaaucccggcgugaaggggugggcuuucgauaacggagacgaugucuggaugggccgcaccauuaauaaggacuccagaagcggguacgaaacauuuaaagugaucggaggcuggucuaccccuaacuccaagagccagguuaaucggcaagugauugucgauaacaauaacuggucuggcuauuccgggaucuucagcguggagggaaaauccugcauuaauagauguuuuuacgucgagcugauccgcggccggccccaggaaacaagagugugguggaccucuaacagcauuguuguguucugcgggacguccggaacauauggcaccgggucuuggcccgacggcgccaauaucaacuuuaugccuaucuga

SEQ ID NO: 198811 - RNA, 1410 nt, Artificial Sequence; identical to SEQ ID NO: 198807
  derived and/or modified sequence opt5 from neuraminidase__InfluenzaA__ABO52250

SEQ ID NO: 198812 - RNA, 1413 nt, Artificial Sequence
  derived and/or modified sequence opt5 from neuraminidase__InfluenzaA__ABO52261
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucaacaauacaaacgugguggcuggaaaagacaccacauccgucacccuggccggcaauucuagccuuugcccuauucgggggugggcgaucuacuccaaggauaacagcauucgcaucggaucuaaaggcgacguguucguuauuagagaaccguuuaucuccuguagccaccuggagugccggacguucuuucucacccagggcgcucugcuuaaugauaagcauucuaacgggacagugaaagaccgcucccccuauagagcccugaugagcuguccuaucggagaagcccccucuccuuacaauucccgguucgagagcgucgcuugguccgccucugcuugccacgauggcaugggguggcucaccauuggaaucagcggccccgacgauggggccguggcgguucugaaguauaacggaauuaucacagaaaccauuaaguccuggcgcaaaagaauccugcggacgcaggagagcgagugugugugcgucaacggcucuuguuuuacaaucaugaccgacggcccuuccaaugggccggccagcuaccgcauuuucaagaucgaaaaaggaaagauuacaaaaucuaucgagcucgaugcucccaacagccauuaugaagagugcuccuguuacccugacaccggcaccgugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugacaguggauggcgccgacggggucaaaggauuuucuuacagauauggcaacgggguguggauuggacggacgaaguccaauagcucucgcaaaggcuucgagaugaucugggauccugacggguggaccgauacagacuccaacuuucuuguuaagcaggauguggucgcuaugaccgacuggagcggcuacuccggaucuuucgugcagcaccccgaacugacaggccucgauuguaucagaccuugcuuuuggguugagcugauucgggggagaccccgcgagaaaaccacgaucuggacaagcggauccucuauuagcuucuguggcgucaauuccgacaccgugaacuggagcuggcccgauggggccgaacuuccuuucaccaucgacaaguga

SEQ ID NO: 198813 - RNA, 1413 nt, Artificial Sequence
  derived and/or modified sequence opt5 from neuraminidase__InfluenzaA__ABO52283
augaaccccaaucagaagaucauuaccaucggcagcauuugcaugacaaucgggacgauuucccugauccuccaaaucggaaacauuaucucuauuuggaucagccacuccauucagaccggcucucagaaucauacagggaucuguaaccagagaauuaucaccuacgagaauaacacaugggugaaucaaaccuaugucaacaucagcaauacaaacguuguggccggaaaagacaccacguccaugauucuggcuggcaauucuagccuuugcccuauccgggggugggccauuuacuccaaggauaacagcauccgcauuggaucuaaaggcgacguguucgucaucagagaaccguuuaucuccuguagccaccuggagugccggaccuucuuucucacacagggcgcgcugcuuaaugauaagcauucuaacgggaccgugaaagaccgcucccccuauagagcucugaugagcuguccuauuggagaagcccccucuccuuacaauucccgguucgagagcguugccugguccgcuucugccugccacgauggcaugggguggcucacaaucggaauuagcggccccgacgauggggcuguggccguccugaaguauaacggaaucauuaccgaaaucaucaaguccuggcgcaaacagauucugagaacgcaggagagcgagugugugugcguuaacggcucuuguuuuacaaucaugaccgacggcccuuccgaugggccggcgagcuaccggauuuucaagaucgaaaaaggaaagauuacaaaaucuaucgagcucgacgcccccaauagccauuaugaagagugcuccuguuacccugauaccggcaaggugaugugcgucugccgcgacaacuggcacgggucuaauagacccugggugagcuuuaaccaaaaucuggauuaccagauuggauauaucuguuccggcguguucggggacaacccucggcccaaggacggaaaaggcagcugcgauccggucaauguugacggcgcugauggggugaagggauuuucuuaccgcuauggcgacgggguguggaucggaagaaccaaauccaacagcucucggaagggcuucgagaugauuugggauccuaauggguggacagacacggaugacaacuuucuugucaaacaggaugugguugccaugaccgacugguccggcuacagcggauccuucgugcagcaccccgaacugacaggccucgauuguaugcgcccuugcuuuugggucgagcugaucagagggcggcccagagaaaagaccacaauuuggaccucuggaagcuccaucucuuucuguggcgugaauagcgacacgguuaacugguccuggcccgacggggcugagcuuccuuucacaauugauauguga

SEQ ID NO: 198814 - RNA, 1410 nt, Artificial Sequence; identical to SEQ ID NO: 198542
  derived and/or modified sequence opt5 from neuraminidase__InfluenzaA__ABO52294

SEQ ID NO: 198815 - RNA, 1410 nt, Artificial Sequence
  derived and/or modified sequence opt5 from neuraminidase__InfluenzaA__ABO52316
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucagaucaugccgugcgaacccacaauuaucgagagaaacauuaccgaaaucguguaucugacaaauauuaccaucgagaaggaaauuuguccuaaacucguggaguaccggaacuggagcaagccccagugcaaaaucacgggguucgcgccuuuuuccaaggauaauucuauccgccugagcgcuggaggcgacauuugggucaccagagagcccuauguguccugugauccuucucggugcuaccaauucgcccuugggcagggaacaacccuggacaacaagcauagcaaugauacaauccacgaccgcaccccgcauagaacgcuccugaugaacgaacugggcguucccuuucaccucgggacacgccagguguguauugccugguccucuagcuccugccaugauggaaaggcuuggcugcacgucugugugaccggcuaugacaaaaaugccacagcuagcuucaucuacgauggccggcuuguugacucuauuggguccuggagccagaacauccugagaacccaagagucugaaugcguguguaucaauggaaccugcacagucgugaugacggauggcuccgccagcgggcgggcggacaccaaaauucucuuuaucgaggagggaaagauugugcacaucuccccucugucuggcagcgcccagcaugucgaagagugcuccuguuauccccgcuacccugggguuagaugcauuugucgggauaacuggaaaggaagcaaucgccccgugguggacaucaacgucaaggacuacucuaucgauuccagcuaugugugcucuggccuuguuggcgacacaccgagaaagaacgaucggagcuccaauucuuacugucgcaacccuaauaacgaaaaagggaaucacggagugaagggcugggcuuucgacgaugggaacgacgucuggaugggaagaaccauuagcgaggauucccggagcggcuaugaaacauuuaaagugaucgggggauggucuacccccaauuccaagcugcagauuaacagacagguuaucguggacagcgauaaucgcucuggcuacuccggcauuuucagcgucgaggggaaauccugcaucaaccgguguuuuuauguggagcucauuagaggacgcgaacaagagacgcgggucugguggacaucuaauagcaucgugguuuucugcggcaccuccgggaccuacggagccggcucuuggccugacggggcugauaucaaccugaugcccauuuga

SEQ ID NO: 198816 - RNA, 1410 nt, Artificial Sequence; identical to SEQ ID NO: 197138
  derived and/or modified sequence opt5 from neuraminidase__InfluenzaA__ABO52327

SEQ ID NO: 198817 - RNA, 1410 nt, Artificial Sequence
  derived and/or modified sequence opt5 from neuraminidase__InfluenzaA__ABO52338
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuugguccaagaacauucugcgcacccaggagagcgaaugcgucuguaucaauggaaccugcacaguggugaugacggaugggucugccuccggcagagcggacaccaaaauccucuuuauugaggagggcaagaucguccacauuagcccucuguccgggucugcccaacauguugaagagugcagcuguuauccccgguacccuggagugcgcugcaucuguagagauaacuggaagggcuccaaucggcccguggucgacauuaacgugaaagacuacagcaucgauucuuccuauguuugcagcggccuugugggggacacaccgcgcaacaaugauagaucuagcuccucuuacugucggaacccuaauaacgaaaagggaaaucacggcgucaaagggugggcuuucgacgauggaaacgacguguggaugggccgcaccaucagcgaggauuccagaagcggguaugaaacauuuaagguuauuggaggcuggucuacccccaauuccaaacugcagaucaacagacaggugauugucgacagcgauaaucggucuggcuacuccgggaucuucagcguggagggaaaguccugcauuaaccgcuguuuuuaugucgagcucauccggggcagagaacaggagacgcgcgugugguggacaucuaauagcauuguuguguucugcgggaccuccggaaccuacggcacagggucuuggccugacggcgccgauaucaaccugaugcccaucuga

SEQ ID NO: 198818 - RNA, 1410 nt, Artificial Sequence
  derived and/or modified sequence opt5 from neuraminidase__InfluenzaA__ABO52349
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacgugacagaaauugucuaucugaccaauacaaccaucgagaaggaaauuuguccuaaacucguggaguaccggaacuggagcaagccccagugcaaaaucacgggguucgcgccuuuuuccaaggauaauucuauucgccugagcgcuggaggcgacaucuggguuaccagagagcccuauguguccugugauccugggaagugcuaccaauucgcccuuggacagggcacaacccuggacaacaaacauucuaaugauacaauccacgaccggaccccguaucgcacgcuccugaugaacgaacuggggguccccuuucaucucggaacaagacagguguguauugccuggagcuccagcucuugccacgauggcaaggcuuggcugcauguuugugugaccggcuacgacaaaaaugccacagcuuccuucaucuaugaugggcggcuugucgacagcauuggaucuugguccaagaacauccugcgcacccaggagagcgaaugcguguguauuaaugggaccugcacaguggucaugacggauggcucugccuccgagagagcggacaccaaaauccucuuuaucgaggaaggaaagauuauccacauuagcccucuguccggcucugcccaacacguugaggaaugcagcuguuacccccgguacccuggggugcgcugcaucuguagagauaacuggaagggauccaaucggcccguggucgacauuaacaugcgcgacuauagcaucgugucuuccuacguuugcagcggccuugugggcgauacaccgcggaaaaacgacagaucuagcuccucuuauugucgcaauccuaacaaugagaaggggaaccauggagucaaaggcugggcuuucgaugacgggaaugauguguggaugggaagaaccaucagcgaagagucccggagcggcuacgagacauuuaagguuauugggggauggucuacccccaacuccaaacugcagaucaauagacaggugauugucgacagcaacaaucgcucuggcuauuccggcaucuucagcguggaagggaaguccugcauuaaccgguguuuuuacgucgagcucaucagaggacgcgaacaggagacgcgggugugguggacaucuaauagcauuguuguguucugcggcaccuccgggaccuauggaacaggcucuuggccugauggggccgacaucaaccugaugcccaucuga

SEQ ID NO: 198819 - RNA, 1410 nt, Artificial Sequence
  derived and/or modified sequence opt5 from neuraminidase__InfluenzaA__ABO52360
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggaaacgauguguggaugggccggaccauuagcaaggaccuuagauccggguaugaaacauuuaagguuaucggaggcuggagcaccccuaauucuaaaucccaaauuaaccgccaggugaucgucgauagcgacaaucggucuggcuacuccgggauuuucagcguggagggaaaguccugcaucaacagauguuuuuaugucgagcugauucgcggccggaaacaggaaacaagagugugguggaccucuaauagcaucguuguguucugcgggacguccggaacauacggcaccgggucuuggcccgauggcgccaacaucaauuuuaugccuauuuga

SEQ ID NO: 198820 - RNA, 1410 nt, Artificial Sequence
  derived and/or modified sequence opt5 from neuraminidase__InfluenzaA__ABO52371
augaaccccaaucagaagaucauuaccaucggcagcgugucccugacaauugccacggucugcuuccucaugcaaaucgcuauucugguuaccacagugacccuucacuuuagacaguacgagugugacucuccugccaacaaucaggugaugccgugcgaacccaucaucauugagcggaacaucacagaaauugucuaucugaauaacaccacaaucgagaaagaaauuuguccuaagcucguggaguaccgcaauuggagcaaaccccagugcaagaucaccggguucgcgccuuuuuccaaagauaacucuauuagacugagcgcuggaggcgacaucuggguuacgcgggagcccuauguguccugugauccugggaagugcuaccaauucgcccuuggacagggcaccacacuggacaauaagcauucuaacgauaccauccacgaccgcauuccgcauagaacacuccugaugaaugaacuggggguccccuuucaccucggaaccagacagguguguaucgccuggagcuccagcucuugccaugauggcaaggcuuggcugcacguuugugugacgggcgacgauaaaaacgccacagcuuccuucauuuaugacgggaaacuugucgauagcaucggaucuuggucccagaauauucugcgcacccaagagagcgaaugcguguguaucaacggcacaugcaccguggucaugaccgacgggucugccuccggacgggcggauacacggauccucuuuauugaggagggcaagaucguucacauuagcccucuguccgggucugcccagcauguggaagagugcagcuguuacccccgcuauccuggagugagaugcaucugucgggacaauuggaaaggcuccaaccgccccgucguggacauuaacguugaagauuacagcaucgacucuuccuacgugugcagcggccuugucggggauacgccgagaaauaacgaccggucuggaaauagcaacugucgcaauccuaacaaugagagaggcaaccacggggugaagggaugggcuuucgaugacggcaaugauguuuggauggggcggaccaucaacaaggaccugagauccggauaugaaacauuuaaagugauuggcggcuggucuacccccaauagcaagucccagaucaaccgccaggucauuguggauagcgacaaucggucuggguacuccggaaucuucagcgucgagggcaaaucuugcauuaacagauguuuuuauguggagcucauccgcgggcgggaacaagagacaagaguuugguggaccuccaauagcauuguggucuucugcggaacguccggcacauacgggaccggcucuuggccugauggagccgacaucaaccugaugcccaucuga

SEQ ID NO: 198821 - RNA, 1413 nt, Artificial Sequence
  derived and/or modified sequence opt5 from neuraminidase__InfluenzaA__ABO52800
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucacgcuggcuggcaauucuagccuuugcccuauucgggggugggccaucuacuccaaggauaacagcauucgcaucggaucuaaaggcgacguguucguuauuagagaaccguuuaucuccuguagccaccuggagugccggaccuucuuucucacacagggcgcgcugcuuaaugauaagcauucuaacgggaccgugaaagaccgcucccccuauagagcucugaugagcuguccuaucggagaagcccccucuccuuacaauucccgguucgagagcgucgccugguccgcuucugccugccacgauggcaugggguggcucacaauuggaaucagcggccccgacgauggggcuguggccguucugaaguauaacggaauuaucaccgaaacgauuaaguccuggcgcaaaagaauccugcggacacaggagagcgagugugugugcgucaacggcucuuguuuuaccaucaugacagacggcccuuccaaugggccggcgagcuaccgcauuuucaagaucgaaaaaggaaagauuaccaaaucuaucgagcucgaugcccccaacagccauuaugaagagugcuccuguuacccugacaccggcacagugaugugcgugugcagagauaauuggcacgggucuaaccggcccugggucagcuuuaaucagaaccuggacuaccaaauuggauauaucuguuccggcguuuucggggauaauccucgccccaaggacggaaagggcagcugcgacccggugacgguggauggcgcugacggggucaaaggauuuucuuacagauauggcaacgggguguggauuggacggaccaaguccaauagcucucgcaaaggcuucgagaugaucugggauccuaacggguggacagacaccgauuccaauuuucuuguuaagcaggacguggucgccaugacagauuggagcggcuacuccggaucuuucgugcagcaccccgaacugaccggccucgacuguaugagaccuugcuuuuggguugagcugauccgggggagaccccgcgaacggacgacaauuuggaccagcggauccucuaucagcuucuguggcgugaacuccgauaccgcuaauuggagcuggcccgacggggccgagcuuccuuucacaauugauaaauga

SEQ ID NO: 198822 - RNA, 1413 nt, Artificial Sequence; identical to SEQ ID NO: 197852
  derived and/or modified sequence opt5 from neuraminidase__InfluenzaA__ABP49220

SEQ ID NO: 198823 - RNA, 1413 nt, Artificial Sequence
  derived and/or modified sequence opt5 from neuraminidase__InfluenzaA__ABP49319
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauaacacaugggucaaucaaaccuauguuaacaucagcaauacaaacgugguggcuggaaaagacaccacauccaugauucuggccggcaauucuagccuuugcccuauccgggggugggcgauuuacuccaaggauaacagcauccgcauuggaucuaaaggcgacgucuucgugaucagagaaccguuuaucuccuguagccaccuggagugccggaccuucuuucucacgcagggcgcucugcuuaaugauaagcauucuaacgggaccguuaaagaccgcucccccuauagagcccugaugagcuguccuauuggagaagcccccucuccuuacaauucccgguucgagagcguggcuugguccgccucugcuugccacgauggcaugggguggcucacaaucggaauuagcggccccgacgauggggccgucgcggugcugaaguauaacggaaucauuaccgaaacaaucaaguccuggcgcaaacagauccugagaacccaggagagcgaguguguuugcgugaacggcucuuguuuuacgauuaugacagacggcccuuccgaugggccggccagcuaccggaucuucaagauugaaaaaggaaagaucaccaaaucuauugagcucgacgcucccaauagccauuaugaagagugcuccuguuacccugauacaggcaaggucaugugcgugugccgcgacaacuggcacgggucuaauagacccugggugagcuuuaaccaaaaucuggauuaccagaucggauauauuuguuccggcgucuucggggacaacccucggcccaaggacggaaaaggcagcugcgauccgguuaauguggacggcgccgauggggugaagggauuuucuuaccgcuauggcaacggggucuggaucggaagaaccaaauccaauagcucucggaagggcuucgagaugaucugggacccuaacggguggaccgauacagacggcaauuuucuugugaaacaggauguuguggcuaugacggacugguccggauacagcggcuccuucguccagcaccccgaacugaccgggcucgauuguaugcgcccuugcuuuuggguggagcugauuagaggacggcccagagaaaagacaaccaucuggacaucuggcagcuccauuucuuucugugggguuaacagcgacaccgugaauugguccuggcccgauggagccgagcuuccuuucacgaucgacaaauga

SEQ ID NO: 198824 - RNA, 1410 nt, Artificial Sequence
  derived and/or modified sequence opt5 from neuraminidase__InfluenzaA__ABP49330
augaaccccaaucagaagaucauuaccaucggcagcauuugcaugguggucgggaucauuucccugauccuccaaaucggaaacauuaucucuauuuggaucagccacuccauucagacaggcucucagaaucauacggggaucuguaaccagagcauuaucaccuacaaaaauuccacauggguuaaccaaaccuaugugaauaucucuaacacaaauguggucgccggaaagggcaccacaccugugauucuggcugggaacagcucccuuugcccgaucagaggaugggccauuuacagcaaagacaauggcauccggauuggcucuaagggggauguuuucgugauccgcgagcccuuuaucuccuguagccaccuggaaugcagaaccuucuuucucacgcagggagcgcugcuuaacgacaaacauucuaauggcaccgucaaggaucgguccccuuaucgcgcucugaugagcugucccgugggggaggccccuucucccuacaacuccagauucgaaagcguugccugguccgcuugcgccugucacgacggaaugggcuggcucacaauugggaucucuggaccugaugacgaggcuguggccguccugaaguauaauggcauuaucaccgaaacaauuaaaagcuggcggaagaaaauccugcgcacccaggaguccgagugcgugugugugaacggcagcugcuuuacgaucaugacagaugggccgucugacggacccgcguccuacaagauuuucaaaaucgaaaagggcaaggucaccaaaagcauugagcucgaugccccuaacucucauuaugaagaguguagcugcuaccccgacacagggaagguuaugugcguguguagagauaauuggcacggauccaaccggccuugggugucuuuugaccagaaucuggauuaccaaaucggcuauauuugcagcggggucuucggagacaacccccgcccgaaagacggcaagggcuccugugggccuguguacguugauggagcuaauggcgugaaaggguuuagcuauagauacggaaacggcgucuggaucgggcggauuaagucuaauuccagccgccagggcuucgagaugaucugggaccccaacggauggaccgaaaccgauucuuccuuuuucgugaaacaggacguuguggccaugacagauuggagcggcuauuccgggucuuuuguccagcacccugagcuuacgggacuggacugcaugagacccuguuucuggguggaacucauccggggccgccccaaggagaagaccauuuggacaagcggguccucuaucagcuucugcggagucaauuccgauaccguggacuggagcuggccugauggcgcugaacugccguuuacaauugacaaauga

SEQ ID NO: 198825 - RNA, 1413 nt, Artificial Sequence
  derived and/or modified sequence opt5 from neuraminidase__InfluenzaA__ABP49352
augaaccccaaucagaagaucauuaccaucggcagcauuugcaugacaaucgggauuaucucccugauccuccaaauuggaaacaucauuucuaucugggugagccacuccauucagacgggcucucagaaucauaccgggaucuguaaccagagaauuaucacauacgagaauagcaccugggucaaccaaacauauguuaauaucaacaauaccaacgugguggccggaaaagacacaaccuccgucgcucuggccggcaauucuagccuuugcccuauucgggggugggcgaucuacuccaaggauaacagcauucgcaucggaucuaaaggcgacguguucguuauuagagaaccguuuaucuccuguagccaccuggagugccggacguucuuucucacccagggcgcucugcuuaaugauaagcauucuaacgggacagugaaagaccgcucccccuauagagcccugaugagcuguccuaucggagaagcccccucuccuuacaauucccgguucgagagcgucgcuugguccgccucugcuugccacgauggcaugggguggcucaccauuggaaucagcggccccgacgauggggccguggcgguucugaaguauaacggaauuaucacagaaaccauuaaguccuggcgcaaaagaauccugcggacgcaggagagcgagugugugugcgucaacggcucuuguuuuacaaucaugaccgacggcccuuccgaugggccggccagcuaccgcauuuucaagaucgaaaaaggaaagauuacaaaaucuaucgagcucgacgcucccaauagccauuaugaagagugcuccuguuacccugauaccggcaccgugaugugcgugugcagagacaacuggcacgggucuaaucggcccugggucagcuuuaaccagaaucuggauuaccaaauuggauauaucuguuccggcguuuucggggacaacccucgccccaaggacggaaagggcagcugcggcccggugacaguggauggggccgacggagucaaaggcuuuucuuacaaguaugggaauggaguguggauuggcagaacgaaauccaacagcucucggaagggguucgagaugaucugggauccuaauggcuggaccgacacagauuccaacuuucuuguuaaacaggacguggucgcuaugaccgauuggagcggauacuccggcucuuucgugcagcaccccgaacugacagggcucgacuguaugcgcccuugcuuuuggguugagcugaucagaggacggcccagagaacgcaccacgauuuggacaagcggcuccucuaucagcuucugugggguggauuccgacaccgccaauuggagcuggcccgauggagcggagcuuccuuucaccauugacaaguga

SEQ ID NO: 198826 - RNA, 1413 nt, Artificial Sequence; identical to SEQ ID NO: 198722
  derived and/or modified sequence opt5 from neuraminidase__InfluenzaA__ABP49363

SEQ ID NO: 198827 - RNA, 1410 nt, Artificial Sequence; identical to SEQ ID NO: 197754
  derived and/or modified sequence opt5 from neuraminidase__InfluenzaA__ABP49374

SEQ ID NO: 198828 - RNA, 1413 nt, Artificial Sequence
  derived and/or modified sequence opt5 from neuraminidase__InfluenzaA__ABP49385
augaaccccaaucagaagaucauuaccaucggcagcauuuccguggccaucgggauuaucaaccugacacuccaaaucggaaauauuaucucuauuugggcuagccacuccauccagacgggcucucagaacuacaccgggauuugcaaucagagaaucauuacauaugagaaccggaccugggucaaucaaacauacguuaacaucaauaacaccaaugugguggccggaaaagacaagacaagcaugacccuggcgggcaacuccucucuuuguccuauccgcgggugggcuauuuauacgaaagauaauagcaucagaauuggauccaagggcgacgucuucgugauccgggaaccguuuauuagcugcucucaucuggagugucgcaccuucuuucucacacagggcgcccugcuuaacgauaaacacuccaaugggaccaucaaggacagaagccccuuccgggcccugaugucuugcccucucggagaagcucccuccccuuacaacagccgcuuugagucuguugccugguccgcuagcgccugucaugauggccugggguggcugacaaucggaauuuccggccccgacaacggggcgguggccguccucaaguauaauggaaucauuaccgaaacgaucaaaucuuggaagaaacagauucugagaacacaggagagcgagugcguguguguuaacggcuccugcuucaccaucaugacagauggcccuagcaaucgggcugccucuuaccgcaucuuuaagauugaaaaagggagagugaccaaguccaucgagcuugacgcuccgaacuaucacuacgaagaguguagcugcuaccccgauaccggaacagucaugugugugugccgggacaauuggcauggcucuaaccgcccuugggugagcuucaaucaaaaccuggauuaucagauuggguacaucugcuccggagucuuuggcgacaaucccagaccuaaggauggggagggaucuuguaaccccguuacgguggacggcgccgacggcgugaaaggguucagcuaucgguacggaaauggcgucuggauugggcgcaccaaguccaacagacuccggaaaggauuugaaaugaucugggauccgaauggcuggacagacaccgauagcgacuucucuaugaagcaggaugugguugcgaugacagacugguccggguauagcggcucuuuugugcagcacccugagcugaccggacuugauugcaugagacccuguuucugggucgaacuggugcgcggccucccucgggagaacacgacaauuuggaccuccgggagcuccaucucuuucugcggaguuaauagcgaaaccgccaacugguccuggcccgacggcgcugagcugcccuuuacaaucgauaaauga

SEQ ID NO: 198829 - RNA, 1413 nt, Artificial Sequence; identical to SEQ ID NO: 197410
  derived and/or modified sequence opt5 from neuraminidase__InfluenzaA__ABP49396

SEQ ID NO: 198830 - RNA, 1410 nt, Artificial Sequence
  derived and/or modified sequence opt5 from neuraminidase__InfluenzaA__ABP49407
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugauguccgaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauuguuagcucuuauguguguagcggacuugucggcgauacccccagaaagaaugacuccucuagcuccagccauugccuggauccgaacaaugaggaaggcgggcacggagugaaaggcugggccuucgacgaugggaacgacguuuggaugggacggacgaucucugagaagcuccgcuccggcuacgagacauuuaaagugaucgaaggguggagcaauccuaacucuaagcugcagauuaauagacaggucaucguggaucggggaaaccgcuccggcuauagcggcauuuucuccgucgaggggaaaaucuguauuaauagaugcuuuuacguggaacugauccggggaagaaaggaggaaaccgagguucucuggaccucuaacagcauuguggucuucuguggcacauccgggaccuauggaacaggcucuuggcccgacggggcugauaucaaucugaugccuaucuga

SEQ ID NO: 198831 - RNA, 1410 nt, Artificial Sequence; identical to SEQ ID NO: 197754
  derived and/or modified sequence opt5 from neuraminidase__InfluenzaA__ABP49418

SEQ ID NO: 198832 - RNA, 1410 nt, Artificial Sequence; identical to SEQ ID NO: 197754
  derived and/or modified sequence opt5 from neuraminidase__InfluenzaA__ABP49429

SEQ ID NO: 198833 - RNA, 1410 nt, Artificial Sequence
  derived and/or modified sequence opt5 from neuraminidase__InfluenzaA__ABP49440
augaaccccaaucagaagaucauuaccaucggcagcgugucccugacaauugccacggucugcuuccucauccaaauugcuauccuggccaccacaguuacccuucacuuuaaacagcaugagugugacucuccugcgagcaaccaggugaugccgugcgaacccaucauuaucgagagaaauauuacagaaaucguguaccugaacaauaccacaauugagaaggaaaucuguccugaggucguggaguaucggaacugguccaaaccccagugccaaauuaccggguucgcuccuuuuucuaaggauaauagcauccgccucuccgccggaggcgacaucuggguuacgagagaacccuacgugucuugugauccugggaaaugcuaucaguucgcccugggacagggcaccacacuugacaacaagcacagcaaugggaccauucaugaucggaucccgcaccgcacacugcucaugaacgagcugggaguccccuuucaucugggcaccaaacagguguguguugcuugguccucuagcuccugccacgacggcaaggccuggcuccacgugugugucacgggggaugacagaaaugcuacagccagcuucauuuacgauggacggcugguggacucuaucggcuccuggagccaaaacauucuucgcacccaggaaucugagugcguguguaucaaugggacaugcaccgucguuaugaccgauggauccgcgagcggcagagccgacacacggauccuguuuauuaaggaggggaaaaucgugcauauuuccccucucucuggaagcgcucagcacaucgaagagugcuccuguuauccccgcuacccugaugugagaugcauuugucgggacaacuggaagggcagcaaucgccccgucaucgacaucaacauggaagauuauucuauugacuccagcuacgugugcucuggccugguuggggauacgccgagaaacgacgauagcuccucuaauagcaacugucgggacccuaauaacgagcgcggaaaucccggcgugaaagggugggccuucgauaacggagacgaugucuggaugggcagaaccaucuccaaggacagccggucuggguacgaaacauuuaaggugauuggaggcugguccaccccuaauagcaaaucucaggcuaacagacaaguuaucguggauaagaauaacugguccggcuauagcgggauuuucuccgucgagggaaaaucuugcaucaaucgcuguuuuuacguggagcuuauucggggcagaccccaggaaacacgcgucugguggaccagcaacuccaucgugguuuucugcgggacgucuggaacauauggcaccgggagcuggcccgacggcgccaauaucaacuuuaugccuauuuga

SEQ ID NO: 198834 - RNA, 1413 nt, Artificial Sequence; identical to SEQ ID NO: 197975
  derived and/or modified sequence opt5 from neuraminidase__InfluenzaA__ABP49451

SEQ ID NO: 198835 - RNA, 1410 nt, Artificial Sequence
  derived and/or modified sequence opt5 from neuraminidase__InfluenzaA__ABP49462
augaaccccaaucagaagaucauuaccaucggcagcgugucccugacaauugccacggucugcuucaucaugcaaauugcuauccucgccaccacaguuacccugcacuuuaaacagcaugagugugacucuccugcgagcaaccaggugaugccgugcgaacccaucauuaucgagagaaauauuacagaaaucguguaccuuaacaauaccacaauugagaaggaaaucuguccugaggcugucgaguaucggaacugguccaaaccccagugccaaauuaccggguucgccccuuuuucuaaggauaauagcauccgccuguccgccggaggcgacaucugggugacgagagaacccuacguuucuugugauccugggaaaugcuaucaguucgcucucggacagggcaccacacuggacaacaagcacagcaaugggaccauucaugaucggaucccgcaccgcacacuucugaugaacgagcucggagugcccuuucaucugggcaccaagcaggucuguguggccugguccucuagcuccugccacgacggcaaggcuuggcugcacguuugugugacgggggaugacagaaaugccacagcgagcuucauuuacgauggacggcucgucgacucuaucggcuccuggagccaaaacauucugcgcacccaggaaucugagugcguguguaucaaugggacaugcaccguggucaugaccgauggauccgccagcggcagagcugacacacggauccuuuuuauuaaagaggggaaaaucguucauauuuccccucugucuggaagcgcccagcacaucgaagagugcuccuguuauccccgcuacccugaugugagaugcauuugucgggacaacuggaagggcagcaaucgccccgugaucgacaucaacauggaagauuauucuauugacuccagcuacgucugcucuggccucgugggggauacgccgagaaacgacgauagcuccucuaauagcaacugucgggacccuaauaacgagcgcggaaaucccggcguuaaagggugggcuuucgauaacggagacgauguguggaugggcagaaccaucaauaaggacucccggagcggguacgaaacauuuaaggucauuggaggcuggucuaccccuaacuccaaaagccaggugaauagacaaguuaucguggauaacaauaacuggucuggcuauuccgggauuuucagcgucgagggaaaguccugcaucaaucgcuguuuuuacguggagcugauucggggcagaccccaggaaacacgcgucugguggaccucuaacagcaucgugguuuucugcgggacguccggaacauauggcaccgggucuuggcccgacggcgccaauaucaacuuuaugccuauuuga

SEQ ID NO: 198836 - RNA, 1410 nt, Artificial Sequence; identical to SEQ ID NO: 198784
  derived and/or modified sequence opt5 from neuraminidase__InfluenzaA__ABP49473

SEQ ID NO: 198837 - RNA, 1410 nt, Artificial Sequence
  derived and/or modified sequence opt5 from neuraminidase__InfluenzaA__ABP49495
augaaccccaaucagaagaucauuaccaucggcagcgugucccugacaauugccacgaucugcuuccucaugcaaauugcuauccuggucaccacaguuacccuucacuuuaaacaguacgagugugacucuccugccaacaaucaggugaugccgugcgaacccaucauuaucgagagaaacauuacagaaaucguguaucugaccaauacaaccauugagaaggaaaucuguccuaaacucgucgaguaccggaacuggagcaagccccagugcaaaauuacgggguucgcgccuuuuuccaaggauaauucuauccgccugagcgcuggaggcgacaucugggugaccagagagcccuauguuuccugugauccugggaagugcuaccaauucgcccuuggacagggcacaacccuggacaacaaacauucuaaugauacaauucacgaccggaccccgcaucgcacgcuccugaugaacgaacugggggugcccuuucaccucggaacaagacaggucuguaucgccuggagcuccagcucuugccaugauggcaaggcuuggcugcacguguguguuaccggcuaugacaaaaaugccacagcuuccuucauuuacgaugggcggcuuguggacagcaucggaucuuggucccagaacauucugcgcacccaagagagcgaaugcgucuguaucaauggaaccugcacaguggugaugacggaugggucugccuccggcagagcggacaccaagauccucuuuauugaggagggcaaaaucguccacacaagcccucuguccgggucugcccagcauguugaagagugcagcuguuauccccgguacccuggagugcgcugcauuuguagagauaacuggcggggcuccaaucgccccguggucgacaucaacgugaaggacuacagcauugauucuuccuauguuugcagcggccuugugggggacaccccgagaaacaaugaucggucuagcuccucuuacugucgcaacccuaauaacgaaaagggaacacacggcgucaaagggugggcuuucgacgauggaaaugacguguggaugggcagaaccaucagcgaggauucccggagcggguaugaaacguuuaagguuaucggaggcuggucuacacccaacuccaaacugcagauuaauagacaggugaucgucgacagcgauaaccgcucuggcuacuccgggauuuucagcguggagggaaaguccugcaucaaucgguguuuuuaugucgagcucauuagaggccgcgaacaagagacccgggugugguggaccucuaacagcaucguuguguucugcgggacauccggaaccuacggcacagggucuuggccugacggcgccgauauuaaucugaugcccaucuga

SEQ ID NO: 198838 - RNA, 1410 nt, Artificial Sequence; identical to SEQ ID NO: 197127
  derived and/or modified sequence opt5 from neuraminidase__InfluenzaA__ABP49506

SEQ ID NO: 198839 - RNA, 1410 nt, Artificial Sequence; identical to SEQ ID NO: 197119
  derived and/or modified sequence opt5 from neuraminidase__InfluenzaA__ABP49517

SEQ ID NO: 198840 - RNA, 1413 nt, Artificial Sequence
  derived and/or modified sequence opt5 from neuraminidase__InfluenzaA__ABQ01314
augaaccccaaucagaagaucauuaccaucggcagcauuugcauggccaucgggacaauuucccugauccuccaaaucggaaacauuaucucuauuugggugagccacuccauccagacgggcucucagaaucauaccgggauuuguaaccagagaaucauuacauacgagaauaacaccugggucaaucaaacauauguuaacaucagcaauaccaacgugguggcuggaaaagacacaaccuccaugauccuggccggcaauucuagccuuugcccuauucgggggugggcgaucuacuccaaggauaacagcauucgcaucggaucuaaaggcgacgucuucgugauuagagaaccguuuaucuccuguagccaccuggagugccggacguucuuucucacccagggcgcucugcuuaaugauaagcauucuaacgggacaguuaaagaccgcucccccuauagagcccugaugagcuguccuaucggagaagcccccucuccuuacaauucccgguucgagagcguggcuugguccgccucugcuugccacgauggcaugggguggcucaccauuggaaucagcggccccgacgauggggccgucgcggugcugaaguauaacggaauuaucacagaaauuaucaaguccuggcgcaaacagauccugagaacccaggagagcgaguguguuugcgugaacggcucuuguuuuacgauuaugacagacggcccuuccgaugggccggccagcuaccggaucuucaagauugaaaaaggaaagaucaccaaaucuauugagcucgacgcucccaauagccauuaugaagagugcuccuguuacccugauacaggcaaggucaugugcgugugccgcgacaacuggcacgggucuaauagacccugggugagcuuuaaccaaaaucuggauuaccagaucggauauauuuguuccggcgucuucggggacaacccucggcccaaggacggaaaaggcagcugcgauccgguuaauguggacggcgccgauggggugaagggauuuucuuaccgcuauggcaacggggucuggaucggaagaaccaaauccaauagcucucggaagggcuucgagaugaucugggacccuaacggguggaccgauacagacggcaauuuucuugugaaacaggauguuguggcuaugacggacugguccggauacagcggcuccuucguccagcaccccgaacugaccgggcucgauuguaugcgcccuugcuuuuggguggagcugauuagaggacggcccagagaaaagacaaccaucuggacaucuggcagcuccauuucuuucugugggguuaacagcgacaccgugaauugguccuggcccgauggagccgagcuuccuuucacgaucgacaaauga

SEQ ID NO: 198841 - RNA, 1413 nt, Artificial Sequence
  derived and/or modified sequence opt5 from neuraminidase__InfluenzaA__ABQ01325
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugcugaaguauaauggaauuaucacagaaaccauuaagagcuggcgcaaacagauccugagaacgcaggagucugaguguguuugcgugaacggcuccuguuuuacaaucaugaccgacggcccuagcgaugggcaagccucuuaccggauuuucaagaucgaaaaaggaaagauuacaaaaagcaucgagcucgacgcuccgaacucccauuaugaagagugcucuuguuaccccgauaccggcaccgucaugugcgugugccgcgacaauuggcacgggagcaacagaccuuggguguccuuuaaucagaaccuggauuaccagauuggauauaucuguagcggcgucuucggggacaauccccggccuaaggacggaaagggcucuugcgaucccguuaacguggacggcgccgauggggugaaaggauuuuccuaccgcuauggcaauggggucuggauuggaagaacaaagagcaacucuucccggaaaggcuucgagaugaucugggacccgaauggguggacggauaccgacagcaacuuucuugugaagcaggauguuguggcuaugacagacugguccggcuacucuggcagcuucguccaacacccugaacugaccggacucgauuguaugcgccccugcuuuuggguggagcugaucagagggcggccuagagagaaaacaaccauuuggacguccggaucuagcaucuccuucuguggcguuaauagcgacacagugaacuggucuuggcccgauggggccgaacuucccuucaccauugacaaguga

SEQ ID NO: 198842 - RNA, 1410 nt, Artificial Sequence; identical to SEQ ID NO: 197754
  derived and/or modified sequence opt5 from neuraminidase__InfluenzaA__ABQ01336

SEQ ID NO: 198843 - RNA, 1410 nt, Artificial Sequence; identical to SEQ ID NO: 197754
  derived and/or modified sequence opt5 from neuraminidase__InfluenzaA__ABQ01347

SEQ ID NO: 198844 - RNA, 1410 nt, Artificial Sequence
  derived and/or modified sequence opt5 from neuraminidase__InfluenzaA__ABQ01358
augaaccccaaucagaagaucauuaccaucggcagcgugucccugacaauugccacggucugcuuccucaugcaaaucgcuauucuggccaccacaguuacccuucacuuuaaacagcaugaguguaacucuccugcgagcaaucaggugaugccgugcgaacccaucaucauugagagaaacaucacagaaauuguguaccugaauaacaccacaaucgagaaggaaauuuguccugaggucguggaguaucggaauugguccaaaccccagugccaaaucaccggguucgcuccuuuuucuaaggacaacagcauucgccucuccgccggaggcgauaucuggguuacgagagaacccuacgugucuugugacccugggaaaugcuaucaguucgcccugggacagggcaccacacuugauaauaagcacagcaacgggaccauccaugaccggauuccgcaccgcacacugcucaugaaugagcugggaguccccuuucaucugggcaccaaacagguguguguugcuugguccucuagcuccugccacgauggcaaggccuggcuccacgugugugucacgggggacgauagaaacgcuacagccagcuucaucuacgacggacggcuggaagauucuauuggcuccuggagccaaaauauccuucgcacccaggagucugagugcguguguauuaacgggacaugcaccguggucaugaccgacggaaaugcguccggcagagccgauacacggauccuguuuaucaaggaagggaaaauuguucauaucagcccucucuccggaucugcucagcacauugaggaaugcagcuguuauccccgcuacccugacgugagaugcaucugucgggauaacuggaagggcuccaaccgccccgugcuggacauuagcauggaggacuauucuaucgauuccagcuacgucugcucuggccuugugggggacacgccgagaaaugaugacagcuccucuaacagcaauugucgggauccuaacaaugaacgcggaaaccccggcguuaaagggugggccuucgacaauggagaugacguguggaugggcagaaccaucuccaaggaucugcggagcggguacgagacauuuaaggucauuggaggcuggucuaccccuaacuccaaaagccaggugaauagacaaguuaucguggacaacaauaacuggucuggcuauuccgggauuuucagcgucgagggaaaguccugcaucaaucgcuguuuuuacguggaacucauucggggcagaucucaggagacacgcgucugguggaccagcaacuccaucgugguuuucugcgggacgucuggaacauauggcaccgggagcuggcccgauggcgcuaauauuaacuuuaugcccaucuga

SEQ ID NO: 198845 - RNA, 1410 nt, Artificial Sequence
  derived and/or modified sequence opt5 from neuraminidase__InfluenzaA__ABQ01369
augaaccccaaucagaagaucauuaccaucggcagcgugucccugacaauugccacgaucugcuucgucaugcaaauugcuauccucguuaccacagugacccugcacuuuaaacaguacgagugugacucuccugccaacaaucaggugaugccgugcgaacccaucauuaucgagagaaacauuacagaaaucgucuaucuuaccaauacaaccauugagaaggaaaucuguccuaaacugguggaguaccggaacuggagcaagccccagugcaaaauuacgggguucgcgccuuuuuccaaggauaauucuauccgccucagcgcuggaggcgacaucuggguuaccagagagcccuauguguccugugauccugggaagugcuaccaauucgcccugggacagggcacaacccuugacaacaaacauucuaaugauacaauucacgaccggaccccgcaucgcacgcugcucaugaacgaacuggggguccccuuucaccugggaacaagacagguguguaucgccuggagcuccagcucuugccaugauggcaaggcuuggcuccacguuugugugaccggcuaugacaaaaaugccacagcuuccuucauuuacgaugggcggcuggucgacagcaucggaucuuggucccagaacauucuucgcacccaagagagcgaaugcguguguaucaauggaaccugcacaguggucaugacggaugggucugccuccggcagagcggacaccaagauccuguuuauugaggagggcaaaaucguucacacaagcccucucuccgggucugcccagcauguggaagagugcagcuguuauccccgguacccuggagugcgcugcauuuguagagauaacuggaagggcuccaaucggcccgucguggacaucaacguuaaggacuacagcauugauucuuccuaugugugcagcggccuggucggggacaccccgcgcaaaaacgauagaucuagcuccucuuacugucggaauccuaacaaugaaaagggaacacacggcgugaaagggugggcuuucgacgauggaaacgacguuuggaugggccgcaccaucagcgaggauuccagaagcggguaugaaacguuuaaggugaucggaggcuggucuacacccaauuccaaacuucagauuaaccggcaggucaucguggacagcgauaauagaucuggcuacuccgggauuuucagcgucgagggaaaguccugcaucaaccgcuguuuuuauguggagcugauucggggcagagaacaagagacccgcguuugguggaccucuaauagcaucguggucuucugcgggacauccggaaccuacggcacagggucuuggccugacggcgccgauauuaaccucaugcccaucuga

SEQ ID NO: 198846 - RNA, 1410 nt, Artificial Sequence
  derived and/or modified sequence opt5 from neuraminidase__InfluenzaA__ABQ44386
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgaguccaagucuugcaucaacagauguuuuuacguggaacucauucggggcagaaagcaggagaaugaaguucuguggacaagcaacuccaucguggucuucugcgggaccucuggaaccuauggcacagggagcuggcccgauggcgccgacauuaaucuuaugccuaucuga

SEQ ID NO: 198847 - RNA, 1410 nt, Artificial Sequence; identical to SEQ ID NO: 197738
  derived and/or modified sequence opt5 from neuraminidase__InfluenzaA__ABQ44408

SEQ ID NO: 198848 - RNA, 1413 nt, Artificial Sequence
  derived and/or modified sequence opt5 from neuraminidase__InfluenzaA__ABQ44419
augaaccccaaucagaagaucauuaccaucggcagcauuugcauggccaucgggauuaucucccugauccuccaaauuggaaacaucgugucuauuuggaucagccacuccauucagaauggcucucagaacuacacagggaucuguaaucagagaauuaucacguaugagaacagcaccugggucaaucaaacauacguuaacaucaauaacaccaaugugguggcuggacaggacacaaccuccgucgcccuggcgggcaacucuagccuuugcccuauuuccgggugggcuaucuauagcaaagauaauucuauucggaucggauccaagggcgacguguucguuauucgcgaaccguuuaucagcuguucucaucuggagugcagaacauucuuucucacccagggcgcccugcuuaacgauaaacacuccaaugggacggugaaggaccggagccccuaccgcgcccugaugucuuguccuaucggagaagcucccuccccuuauaacagcagauucgaguccgucgccuggucugcuagcgccugccaugauggcaugggguggcucaccauuggaaucuccggccccgacgauggggcgguggccguucugaaauacaacggaauuaucacagaaaccauuaagagcuggcggaagcgcauccugagaacacaggagucugagugugugugcgucaauggcuccuguuuuaccaucaugacggacggcccuaacaaugggccggcuagcuauaaaauuuucaagaucgaaaaaggaaagauuacaaaaucuaucgagcucgaugcccccaacagccacuacgaagagugcuccuguuacccugacgcuggcaccgugaugugcgugugccgggauaauuggcaugggucuaaccgccccugggucagcuuuaaucaaaaccuggacuaucagauuggauacaucuguuccggcguuuucggggauaauccuagacccaaggacggaaagggcagcugcggcccggugacaguggacggggccgauggagucaaaggcuuuucuuaucgguacgggaacggaguguggauuggccgcaccaaguccaauagcucuagacggggguucgagaugaucugggacccuaacggcuggaccgauacagacuccaaauuucuuguuaagcaggauguggucgcgaugacggacuggagcggauauuccggcucuuucgugcagcaccccgaacugaccgggcucgauuguaugcgcccuugcuuuuggguugagcugaucagaggacggcccagagaaaauacaaccauuuggacaagcggcuccucuaucagcuucuguggggugaacggagacaccgccaauugguccuggcccgauggcgcugagcuuccuuucacgauugacaaauga

SEQ ID NO: 198849 - RNA, 1410 nt, Artificial Sequence; identical to SEQ ID NO: 197370
  derived and/or modified sequence opt5 from neuraminidase__InfluenzaA__ABQ44430

SEQ ID NO: 198850 - RNA, 1410 nt, Artificial Sequence; identical to SEQ ID NO: 198800
  derived and/or modified sequence opt5 from neuraminidase__InfluenzaA__ABQ44441

SEQ ID NO: 198851 - RNA, 1410 nt, Artificial Sequence; identical to SEQ ID NO: 198784
  derived and/or modified sequence opt5 from neuraminidase__InfluenzaA__ABQ44463

SEQ ID NO: 198852 - RNA, 1413 nt, Artificial Sequence
  derived and/or modified sequence opt5 from neuraminidase__InfluenzaA__ABQ44474
augaaccccaaucagaagaucauuaccaucggcagcauuugcaugacaaucgggacgauuucccugauccuccaaaucggaaacauuaucucuauuugggugagccacuccauccagaccggcucucagaaucauacagggauuuguaaccagagaaucauuaccuacgagaauaacacaugggucaaucaaaccuauguuaacaucagcaauacaaacgugguggccggaaaagacaccacguccaugauccuggcuggcaauucuagccuuugcccuauucgggggugggccaucuacuccaaggauaacagcauucgcaucggaucuaaaggcgacgucuucgugauuagagaaccguuuaucuccuguagccaccuggagugccggaccuucuuucucacacagggcgcgcugcuuaaugauaagcauucuaacgggaccguuaaagaccgcucccccuauagagcucugaugagcuguccuaucggagaagcccccucuccuuacaauucccgguucgagagcguggccugguccgcuucugccugccacgauggcaugggguggcucacaauuggaaucagcggccccgacgauggggcugucgccgugcugaaguauaacggaauuaucaccgaaauuaucaaguccuggcgcaaacagauccugagaacgcaggagagcgaguguguuugcgugaacggcucuuguuuuacaauuaugaccgacggcccuuccgaugggccggcgagcuaccggaucuucaagauugaaaaaggaaagaucacaaaaucuauugagcucgacgcccccaauagccauuaugaagagugcuccuguuacccugauaccggcaaggucaugugcgugugccgcgacaacuggcacgggucuaauagacccugggugagcuuuaaccaaaaucuggauuaccagaucggauauauuuguuccggcgucuucggggacaacccucggcccaaggacggaaaaggcagcugcgauccgguuaauguggacggcgcugauggggugaagggauuuucuuaccgcuauggcaacggggucuggaucggaagaaccaaauccaauagcucucggaagggcuucgagaugaucugggacccuaacggguggacagauacggacggcaauuuucuugugaaacaggauguuguggccaugaccgacugguccggauacagcggcuccuucguccagcaccccgaacugacagggcucgauuguaugcgcccuugcuuuuggguggagcugauuagaggacggcccagagaaaagaccacaaucuggaccucuggcagcuccauuucuuucugugggguuaacagcgacacggugaauugguccuggcccgauggagcugagcuuccuuucacaaucgacaaauga

SEQ ID NO: 198853 - RNA, 1410 nt, Artificial Sequence; identical to SEQ ID NO: 197119
  derived and/or modified sequence opt5 from neuraminidase__InfluenzaA__ABR15800

SEQ ID NO: 198854 - RNA, 1413 nt, Artificial Sequence; identical to SEQ ID NO: 198840
  derived and/or modified sequence opt5 from neuraminidase__InfluenzaA__ABR15811

SEQ ID NO: 198855 - RNA, 1413 nt, Artificial Sequence; identical to SEQ ID NO: 197852
  derived and/or modified sequence opt5 from neuraminidase__InfluenzaA__ABR15910

SEQ ID NO: 198856 - RNA, 1410 nt, Artificial Sequence; identical to SEQ ID NO: 197178
  derived and/or modified sequence opt5 from neuraminidase__InfluenzaA__ABR15932

SEQ ID NO: 198857 - RNA, 1410 nt, Artificial Sequence
  derived and/or modified sequence opt5 from neuraminidase__InfluenzaA__ABR15943
augaaccccaaucagaagaucauuaccaucggcagcgugucccugacaauugccacgaucugcuuccucaugcaaauugcuauccuggucaccacaguuacccuucacuuuagacaguacgaguguaacucuccuccgaauaaccaggugaugcugugcgaacccacaaucauugagcggaauaucaccgaaauuguguaucucacaaacaccacgaucgagaaagaaauuuguccuaagcuggccgaguaccgcaauuggagcaaaccccagugcaacaucaccggguucgcgccuuuuuccaaggacaauucuauuagacuuagcgcuggaggcgauaucugggucacacgggagcccuauguguccugugacccugauaaaugcuaccaauucgcccuggggcagggaaccacacucaacaauggccauucuaacgacaccguucacgaucgcacgccguauagaacacugcugaugaaugaacucggggugcccuuucaucugggaacccggcaggucuguaucgccuggagcuccagcucuugccacgacggcaaggcuuggcuucauguguguguuacaggcgaugacgagaacgccaccgcuuccuucauuuacaaugggcgccugguggauagcaucggaucuugguccaagaaaauucucagaacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccucgguaccccggagugcgcugcguguguagagacaacuggaaaggcuccaaucggccuaucgucgauauuaacgugaaggacuacagcaucguuucuuccuaugugugcagcggccuggucggggacacaccccgcaagaaugauucuuucagcuccucucauugucucgacccgaacaaugaggaaggaggccacggggugaaaggaugggcuuuugaugacggcaacgauguuuggauggggagaaccauuagcgagaagcugcgguccggauacgagacguucaaagugaucgaaggcuggagcaagccuaauucuaaacugcagacaaaccgccaggucaucguggagagaggcaaucgguccggguauagcggaaucuuuucugucgaaggcaaguccugcauuaacagauguuucuacguggagcucauucgcgggcggaaagaagagaccgagguuugguggaccagcaauuccaucguggucuuuugcggaacaucuggcaccuaugggacaggcagcuggcccgacggagccgauauuaaccugaugccuaucuga

SEQ ID NO: 198858 - RNA, 1410 nt, Artificial Sequence
  derived and/or modified sequence opt5 from neuraminidase__InfluenzaA__ABR15954
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccggagugcggugcgugugucgcgacaacuggaagggcuccaauagaccuaucgucgauauuaacgugaaggacuacagcaucguuucuuccuaugugugcagcggccuggucggggacacaccccggaaaaauaacucuuucagcuccucucauugucucgauccgaauaacgaggaaggaggccacggggugaagggaugggcuuuugacgauggcaaugacguuuggauggggcgcaccauuagcgagaaacugagauccggauacgagacguucaaggugaucgaaggcuggagcaaaccuaacucuaagcugcagacaaaucggcaggucaucguggagcgcggcaacagauccggguauagcggaaucuuuucugucgaaggcaaauccugcauuaaucgguguuucuacguggagcucauuagagggcgcaaggaagagaccgagguuugguggaccagcaacuccaucguggucuuuugcggaacaucuggcaccuaugggacaggcagcuggcccgauggagccgacauuaaucugaugccuaucuga

SEQ ID NO: 198859 - RNA, 1410 nt, Artificial Sequence; identical to SEQ ID NO: 197178
  derived and/or modified sequence opt5 from neuraminidase__InfluenzaA__ABR15965

SEQ ID NO: 198860 - RNA, 1410 nt, Artificial Sequence
  derived and/or modified sequence opt5 from neuraminidase__InfluenzaA__ABR22243
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaggcuuggcuucauguguguguuacaggcgaugacgagaacgccaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaccgauucuagcuccucuagccauugucucgacccuaauaacgaggaaggaggccacggggugaaaggaugggcuuucgaugacggcaaugauguuuggauggggcggacgaucuccgagaaaagccgcucuggauacgagacauuuaaagugauugaaggcugguccaagcccaacagcaaacugcagaucaauagacaggucaucguggaccggggcaaccgcucuggguauuccggaauuuucagcgucgagggcaaguccugcaucaauagauguuuuuacguggaacugauucgggggagaaagcaggagaccgaaguucucuggaccucuaacagcaucguggucuucugcggaacauccggcaccuaugggacaggcucuuggccugauggagccgaccugaaucuuaugcccauuuga

SEQ ID NO: 198861 - RNA, 1410 nt, Artificial Sequence; identical to SEQ ID NO: 197754
  derived and/or modified sequence opt5 from neuraminidase__InfluenzaA__ABR28518

SEQ ID NO: 198862 - RNA, 1410 nt, Artificial Sequence; identical to SEQ ID NO: 197600
  derived and/or modified sequence opt5 from neuraminidase__InfluenzaA__ABR28595

SEQ ID NO: 198863 - RNA, 1413 nt, Artificial Sequence
  derived and/or modified sequence opt5 from neuraminidase__InfluenzaA__ABR28771
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaagucccgcgagcugaaugcuccuaacuuucacuaugaagaguguucuugcuacccggacaccggcaccgugaugugugugugcagagauaauuggcacgggagcaaccggcccugggucuccuucaaucagaaccuugacuaccagaucggauauauuugcagcggcguuuuuggggauaauccucgccccaaagacggagagggcucuuguaacccugugacaguggauggcgccgacggggucaagggauucuccuacaaauauggcaaugggguguggaucggaagaacgaaguccaaccggcugcgcaaaggcuuugaaaugauuugggaccccaauggguggaccgauacagacucuaacuucuccguuaagcaagauguggucgcgaucaccgacuggagcggcuacuccggaucuuuugugcagcauccggagcucacaggccuggauugcauuagaccuuguuucuggguugaacuugugcgggggcugccccgcgagaauaccacgaucuggacaagcggauccucuaucagcuucugcggcgucaacuccgacaccgccaacuggagcuggccugauggggcugaacuccccuuuaccauugacaaguga

SEQ ID NO: 198864 - RNA, 1413 nt, Artificial Sequence
  derived and/or modified sequence opt5 from neuraminidase__InfluenzaA__ABR28782
augaaccccaaucagaagaucauuaccaucggcagcauuuccaucgccauugggauccugucucucaugcugcaaaucggaaacauuaucagcauuugggcuucccacucuauccagacaggcagccagaaucauacggggauuugcaaccagagaaucauuaccuacgagaauagcacaugggugaaccacaccuaugucaauaucaacaauacaaacguuguggccggaaaagacaagaccucugugacacuugcgggcaauagcucccuguguagcaucucugggugggcuauuuacaccaaagauaacuccauccggauuggaagcaagggcgacgucuucgugauccgcgaaccuuuuauuucuugcucccaucucgaguguagaacguucuuucugacccaaggcgcccuucugaaugauaaacacagcaacgggacaguuaaggaccggucuccguaucgcgcccucauguccugcccccugggagaagcuccuagccccuacaauuccaaguucgagucuguggccuggagcgcuuccgccugucaugauggcaugggguggcugaccaucggaaucagcggcccugacaacggggcggucgccgugcucaaauauaacggaauuaucacagaaaccauuaagucuuggaaaaagagaauccugcggacgcaggaguccgagugcguuugugugaauggcagcugcuuuacaauuaugaccgauggccccucuaacggggcugccagcuacaaaaucuucaagaucgaaaagggaaaagucacaaaguccauugagcuuaaugcuccuaacuuucacuaugaagaguguucuugcuacccggacaccggcaccgugaugugugugugccgcgauaauuggcacgggagcaacagacccugggucuccuucaaucagaaccuggacuaccagaucggauauauuugcagcggcguuuuuggggauaauccucggcccaaagacggagagggcucuuguaacccugugacaguggauggcgccgacggggucaagggauucuccuacaaauauggcaaugggguguggaucggacgcacgaaguccaacagacuccggaaaggcuuugaaaugauuugggaccccaauggguggaccgauacagacucuaacuucuccguuaagcaagauguggucgcgaucaccgacuggagcggcuacuccggaucuuuugugcagcauccggagcugacaggccuugauugcauucgcccuuguuucuggguugaacuggugagagggcucccccgggagaauaccacgaucuggacaagcggauccucuaucagcuucugcggcgucaacuccgacaccgccaacuggagcuggccugauggggcugaacugcccuuuaccauugacaaguga

SEQ ID NO: 198865 - RNA, 1410 nt, Artificial Sequence; identical to SEQ ID NO: 197868
  derived and/or modified sequence opt5 from neuraminidase__InfluenzaA__ABR28793

SEQ ID NO: 198866 - RNA, 1413 nt, Artificial Sequence; identical to SEQ ID NO: 197852
  derived and/or modified sequence opt5 from neuraminidase__InfluenzaA__ABR28804

SEQ ID NO: 198867 - RNA, 1410 nt, Artificial Sequence; identical to SEQ ID NO: 197754
  derived and/or modified sequence opt5 from neuraminidase__InfluenzaA__ABR28815

SEQ ID NO: 198868 - RNA, 1410 nt, Artificial Sequence; identical to SEQ ID NO: 197178
  derived and/or modified sequence opt5 from neuraminidase__InfluenzaA__ABR28826

SEQ ID NO: 198869 - RNA, 1413 nt, Artificial Sequence; identical to SEQ ID NO: 197420
  derived and/or modified sequence opt5 from neuraminidase__InfluenzaA__ABR28837

SEQ ID NO: 198870 - RNA, 1413 nt, Artificial Sequence
  derived and/or modified sequence opt5 from neuraminidase__InfluenzaA__ABR28848
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgugggaaaagacaagaccucugucacacuggccggcaauagcucccuuuguagcauuucugggugggcgaucuacaccaaagauaacuccauucggaucggaagcaagggcgacguguucguuauucgcgaaccuuuuaucucuugcucccaucuggaguguagaacguucuuucucacccaaggcgcucugcuuaaugauaaacacagcaacgggacagugaaggaccggucuccguaucgcgcccugauguccugcccccucggagaagccccuagccccuacaauuccaaguucgagucugucgcuuggagcgccuccgcuugucaugauggcaugggguggcugaccaucggaauuagcggcccugacaacggggccguggcgguucugaaauauaacggaaucauuacagaaaccaucaagucuuggaaaaagcagauucucagaacgcaggaguccgagugcgugugugucaauggcagcugcuuuacaaucaugaccgauggccccucuaacggggccgcuagcuacaaaaucuucaagauugaaaagggaaaaaucacaaaguccauugagcugaaugccccuaacuuucacuaugaagaguguucuugcuacccggacaccggcaccgugaugugugugugccgggauaauuggcacgggagcaaccgccccugggucuccuucaaucagaaccuugacuaccaaaucggauauauuugcagcggcguuuuuggggauaauccuagacccaaagacggagagggcucuuguaacccugugacaguggauggcgcuaauggggucaagggauucuccuacaaauauggcaacgggguguggaucggacggacgaaguccaaucgccugagaaaaggcuuugaaaugguuugggaccccaacggguggaccgacacagauucugacuucuccgugaagcaggaugucguggccauuaccgacuggagcggcuacuccggaucuuuuguucagcauccggagcucacaggccugaauugcauccggccuuguuucuggguggaacuuguccgcgggcugcccaaggagaacaccacgaucuggacaagcggauccucuauuagcuucugcggcgugaacuccgauaccgcgaauuggagcuggccugacggggccgaacuccccuuuaccaucgauaaauga

SEQ ID NO: 198871 - RNA, 1410 nt, Artificial Sequence
  derived and/or modified sequence opt5 from neuraminidase__InfluenzaA__ABR28859
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgggcggacgccguaucgcacacugcugaugaaugaacucggagugcccuuucaucugggcaccagacaggucuguaucgccuggagcuccagcucuugccacgauggcaaggcuuggcuucauguguguguuacaggggacgaugagaacgccaccgcuuccuucauuuacaauggacggcugguggacagcaucggcucuugguccaaaaagauucuccgcacccaggaaagcgagugcgucuguaucaacgggacaugcacgguggugaugaccgauggaucugccuccggcaaagcggacacaaagauucuguuuaucgaggaagggaaaaucguccacauuagcacccuuuccggaucugcccaacacguugaggaaugcagcuguuauccuagauaccccggcgugcggugcgugugucgcgauaacuggaagggcuccaauagaccuaucgucgacauuaacgugaaggauuacagcaucguuucuuccuaugugugcagcgggcuggucggagacacaccccggaaaaaugacucuuucagcuccucucauugucucgauccgaacaaugaggaaggcgggcacggagugaagggcugggcuuuugacgaugggaacgacguuuggaugggacgcaccauuagcgagaaacugagauccggcuacgagacguucaaggugaucgaaggcuggagcaaaccuaauucuaagcugcagaucaaccggcaggucauuguggagcgcgggaauagauccggauauagcggcaucuuuucugucgaagggaaauccugcauuaaccgguguuucuacguggagcucaucagaggacgcaaggaagagacagagguuugguggaccagcaauuccauuguggucuuuugcggcaccucugggacauauggcaccggaagcuggcccgauggcgccgacaucaaccugaugccuauuuga

SEQ ID NO: 198872 - RNA, 1410 nt, Artificial Sequence
  derived and/or modified sequence opt5 from neuraminidase__InfluenzaA__ABR28870
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaacaguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggcuuggcuucauguguguguuaccggcgaugacgagaacgccaccgcuuccuucaucuacaaugggcggcugguggauagcauuggaucuugguccaaaaagauccuccgcacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacauucaaggugauugaaggcuggagcaaaccuaauucuaagcugcagaucaaccggcaggucaucguggagcgcggcaauagauccggguauagcggaaucuuuucugucgaaggcaaauccugcauuaaccgguguuucuacguggagcucauuagagggcgcaaggaagagaccgagguuugguggaccagcaauuccaucguggucuuuugcggaacaucuggcaccuaugggacaggcagcuggcccgacggagccgauauuaaccugaugccuaucuga

SEQ ID NO: 198873 - RNA, 1410 nt, Artificial Sequence
  derived and/or modified sequence opt5 from neuraminidase__InfluenzaA__ABR28881
augaaccccaaucagaagaucauuaccaucggcagcgugucccugacaauugccacggucugcuuccucaugcaaaucgcuauucugguuaccacagugacccuucacuuuaaacaguacgaguguaacucuccuccgaauaaccaggugaugcugugcgaacccacaaucaucgagagaaauauuaccgaaaucgucuaucucacaaacaccacgauugagaaggaaaucuguccuaaacuggccgaguaccggaauuggagcaagccccagugcaacauuaccggguucgcgccuuuuuccaaagacaauucuauccgccuuagcgcuggaggcgauauuugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccagacagguguguaucgccuggagcuccagcucuugccacgacggcaaggcuuggcuucauguuugugugacaggcgaugacgagaacgccaccgcuuccuucaucuacaaugggcggcuggucgauagcauuggaucuugguccaaaaagauccuccgcacccaggaaagcgagugcguguguauuaacggcacaugcacgguggucaugaccgacgggucugccuccggaaaagcggauacaaagauccuguuuauugaggaaggcaaaaucguucacaucagcacccuuuccgggucugcccaacacguggaggaaugcagcuguuauccuagauaccccggagugcggugcgucugucgcgacaacuggaagggcuccaauagaccuauuguggauaucaacguuaaggacuacagcauugugucuuccuaugucugcagcggccuggugggggacacaccccggaaaaaugauucuuucagcuccucucauugucucgacccgaacaaugaggaaggaggccacgggguuaagggaugggcuuuugaugacggcaacgauguguggauggggcgcaccaucagcgagaaacugagauccggauacgagacguucaaggucauugaaggcuggagcaaaccuaauucuaagcugcagacaaaccgccaggugaucgucgagcggggcaauagauccggguauagcggaaucuuuucuguggaaggcaaauccugcauuaaccgguguuucuacguugagcucaucagagggcgcaaggaagagaccgaggugugguggaccagcaauuccauugucguguuuugcggaacaucuggcaccuaugggacaggcagcuggcccgacggagccgauaucaaccugaugccuauuuga

SEQ ID NO: 198874 - RNA, 1410 nt, Artificial Sequence; identical to SEQ ID NO: 197738
  derived and/or modified sequence opt5 from neuraminidase__InfluenzaA__ABR28892

SEQ ID NO: 198875 - RNA, 1413 nt, Artificial Sequence; identical to SEQ ID NO: 197410
  derived and/or modified sequence opt5 from neuraminidase__InfluenzaA__ABR28903

SEQ ID NO: 198876 - RNA, 1410 nt, Artificial Sequence
  derived and/or modified sequence opt5 from neuraminidase__InfluenzaA__ABR28925
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagaggugcugcggacccaggaaucugagugugugugcaucaaugggacauguacggucguuaugaccgauggauccgcuagcggcaaggccgacacaaaaauucucuuuaucgaggaagggaagaucgugcacaccuccacacugucuggaagcgcgcaacacguggaggaaugcuccugcuauccucgcuaccccggcgucagaugugugugccgggauaacuggaaggggagcaaccgcccuauuguugacaucaauauuaaagacuacucuaucguguccagcuaugucuguucuggacuugugggcgauacccccagaaagaacgacagcuccucuagcucccauugccuggauccgaauaacgaggaaggcgggcacggaguuaaaggcugggccuucgacgaugggaaugacguguggaugggacggacgauuagcgagaagcuccgcucuggcuacgagacauuuaaagucaucgaagggugguccaacccuaauagcaagcugcagaucaacagacaggugauugucgaucggggaaaucgcucuggcuauuccggcaucuucagcguggaggggaaauccuguauuaacagaugcuuuuacguugaacugauccggggaagaaaggaggaaaccgaggugcucuggaccucuaauagcauugucguguucuguggcacauccgggaccuauggaacaggcucuuggcccgacggggcugauaucaaccugaugccuauuuga

SEQ ID NO: 198877 - RNA, 1410 nt, Artificial Sequence
  derived and/or modified sequence opt5 from neuraminidase__InfluenzaA__ABR88082
auggaccccaaccagaagaucauuaccaucggcagcgugucccugacaauuucuacgaucugcuucuuuaugcaaaccgccauucucaucacaaccgucacacugcacuucaaacaguacgaguuuaauagcccuccgaacaaucagguuaugcuuugugaacccaccaucauugagagaaacaucacagaaauuguguaucugaccaauacgaucauugagaaggaaaucugcccuaaacucgcugaguaccggaacugguccaagccccagugugauauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucugucguguccuggagcaaagacauucugcggacccaggagucugaaugugugugcaucaacgggacauguacggucguuaugaccgauggauccgcuagcggcaaggccgacacaaaaauucucuuuaucgaggaggggaagaucgugcacaccuccacacugucuggaagcgcgcaacacguggaagagugcuccugcuauccucgcuaccccggcgucagaugugugugccgggacaauuggaaggggagcaaccgcccuauuguugauaucaacauuaaaaauuacucuaucguguccagcuaugucuguucuggacuugugggcgacacccccagaaagacggauagcuccucuagcucccauugccuggacccgaacaaugaagagggcgggcacggaguuaaaggcugggccuucgaugacgggaacgauguguggaugggacggacaauuagcgaaaagcuccgccugggcuacgagaccuuuaaagucaucgagggguggucuaauccuaacuccaagcugcagaucaauagacaggugauugucgaccggggaaaccgcagcggcuauucuggcaucuucuccguggaagggaaaagcuguauuaauagaugcuuuuacguugagcucauccggggaagaaaggaagagaccgaagugcuguggacauccaacucuauugucguguucuguggcaccagcgggacauauggaacgggcuccuggcccgauggggcugacaucaaucuuaugccuauuuga

SEQ ID NO: 198878 - RNA, 1413 nt, Artificial Sequence
  derived and/or modified sequence opt5 from neuraminidase__InfluenzaA__ABS00324
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucgcccuggcgggcaauucuagccuuugcccuauuuccgggugggcuaucuauagcaaagauaacucuauucggaucggauccaagggcgacguguucguuauucgcgaaccguuuaucagcuguucucaucuggagugcagaaccuucuuucucacgcagggcgcccugcuuaaugauaaacacuccaacgggaccgugaaggaccggagccccuaccgcgcccugaugucuuguccuaucggagaagcucccuccccuuauaauagcagauucgaguccgucgccuggucugcuagcgccugccaugauggcaugggguggcucacaauuggaaucuccggccccgacgauggggcgguggccguucugaaauacaacggaauuaucaccgaaacaauuaagagcuggcggaagcgcauccugagaacccaggagucugagugugugugcgucaacggcuccuguuuuacgaucaugacagacggcccuaauaacgggccggcuagcuauaaaauuuucaagaucgaaaaaggaaagauuaccaaaucuaucgagcucgaugcccccaauagccacuacgaagagugcuccuguuacccugacgcuggcacagugaugugcgugugccgggauaacuggcgcgggucuaauagacccugggucagcuuuaaccaaucccuggacuaucagauuggauacaucuguagcggcguuuucggggauaauccucggcccaaggacggaaagggcucuugcgacccggugaccguggauggcgccgacggggucaaaggauuuuccuaucgcuacggcaacgggguguggauuggaagaaccaagagcaauucuucccggcgcggcuucgagaugaucugggauccuaacggguggacagacacggauagcaaauuucuuguuaagcaggacguggucgcgaugaccgauugguccggcuauucuggcagcuucgugcagcaucccgaacugacaggacucgacuguaugagaccuugcuuuuggguugagcugauccgggggagaccccgcgaaaauaccacaauuuggaccuccggaucuagcaucuccuucuguggcgugaacggggauacggccaauuggagcuggcccgacggaucugagcuuccuuucacaauugauaaauga

SEQ ID NO: 198879 - RNA, 1410 nt, Artificial Sequence; identical to SEQ ID NO: 197138
  derived and/or modified sequence opt5 from neuraminidase__InfluenzaA__ABS49902

SEQ ID NO: 198880 - RNA, 1410 nt, Artificial Sequence
  derived and/or modified sequence opt5 from neuraminidase__InfluenzaA__ABS49913
augaaccccaaucagaagaucauuaccaucggcagcgugucccugacaauugccacggucugcuuccucaugcaaaucgcuauucugguuaccacagugacccuucacuuuagacaguacgagugugacucuccuacaaacaaucaggugaugccgugcgaacccaucaucauugagcggaacaucaccgaaauugucuaucugaauaacacaaccaucgagaaagaaauuuguccuaagcucguggaguaccgcaauuggagcaaaccccagugcaagaucacgggguucgccccuuuuuccaaagauaacucuauuagacugagcgcgggaggcgacaucuggguuacccgggagcccuauguguccugugauccugggaagugcuaccaauucgcucuuggacagggcacaacccuggacaauaagcauucuaacgauacaauccacgaccgcauuccgcauagaacccuccugaugaaugaacuggggguccccuuucaccucggaacgcgccagguguguaucgccuggagcuccagcucuugccaugauggcaaagccuggcugcacguuugugugacaggcgacgauaagaacgcuaccgccuccuucauuuaugacgggcggcuugucgauagcaucggaucuuggucccagaauauucugagaacacaagagagcgaaugcguguguaucaacgggaccugcaccguggucaugacagacggcucugcuuccggacgggccgauacgcgcauccucuuuauugaggagggcaaaaucguucacauuagcccucuguccgggucugcgcagcauguggaagagugcagcuguuaccccagauauccuggagugcggugcaucugucgcgacaauuggaagggcuccaacagacccgucguggacauuaacguugaagauuacagcaucgacucuuccuacgugugcagcggccuugucggggauaccccgcggaauaacgaccgcucuagcaauuccaacuguagaaauccuaacaaugagcggggaaaccacggcgugaaagggugggccuucgaugacggaaaugauguuuggaugggcagaacaaucucuaaggaccugcgcagcggguaugaaaccuuuaaggugauuggaggcugguccacacccaacagcaaaucucagaucaaucggcaggucauuguggauuccgacaacagaagcggcuacucugggaucuucuccgucgagggaaagagcugcauuaaucgcuguuuuuauguggagcucauccggggcagagaacaagagacccgcguuugguggacguccaacucuauuguggucuucugcgggacaagcggaaccuacggcaccggguccuggccugauggcgcugacaucaaucugaugcccaucuga

SEQ ID NO: 198881 - RNA, 1410 nt, Artificial Sequence; identical to SEQ ID NO: 197868
  derived and/or modified sequence opt5 from neuraminidase__InfluenzaA__ABS49968

SEQ ID NO: 198882 - RNA, 1413 nt, Artificial Sequence; identical to SEQ ID NO: 198864
  derived and/or modified sequence opt5 from neuraminidase__InfluenzaA__ABS49979

SEQ ID NO: 198883 - RNA, 1413 nt, Artificial Sequence
  derived and/or modified sequence opt5 from neuraminidase__InfluenzaA__ABS49990
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugauucuggcgggcaauagcucccuuuguagcaucucugggugggcuauuuacacaaaagauaacuccauccggauuggaagcaagggcgacgucuucgugauccgcgagccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagagaauccuccggacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgcgauaauuggcacgggagcaacagacccugggucuccuucaaucagaaccuugacuaccagaucggauauauuugcagcggcguuuuuggggauaauccucggcccaaagacggagagggcucuuguaacccugugaccguggauggcgccgacggggucaagggauucuccuacaaauauggcaaugggguguggaucggacgcacaaagagcaacagacugcggaaaggcuuugaaaugauuugggaccccaauggguggacggauaccgacucuaacuucuccguuaagcaagauguggucgcgaucacagacuggagcggcuacuccggaucuuuugugcagcauccggagcucaccggccuggauugcauccgcccuuguuucuggguugaacuugugagagggcugccccgggagaauacaaccauuuggacgagcggauccucuaucagcuucugcggcgucaacuccgacacagccaacuggagcuggccugauggggcugaacuccccuuuaccauugacaaguga

SEQ ID NO: 198884 - RNA, 1410 nt, Artificial Sequence; identical to SEQ ID NO: 197754
  derived and/or modified sequence opt5 from neuraminidase__InfluenzaA__ABS50001

SEQ ID NO: 198885 - RNA, 1410 nt, Artificial Sequence; identical to SEQ ID NO: 197754
  derived and/or modified sequence opt5 from neuraminidase__InfluenzaA__ABS50012

SEQ ID NO: 198886 - RNA, 1410 nt, Artificial Sequence
  derived and/or modified sequence opt5 from neuraminidase__InfluenzaA__ABS50023
augaaccccaaucagaagaucauuaccaucggcagcgugucccugacaauugccacgaucugcuuccucaugcaaauugcuguccugguuaccacagugacccuucacuuuaaacaguacgaguguaacccuccgcccaauaaccaggugaugcugugcgaaccuacaaucaucgagagaaauauuaccgaaaucgucuaucucacaaacaccacgauugagaaggaaaucugucccaaacuggccgaguaccggaauuggucuaagccucagugcaacauuaccggguucgcgcccuuuagcaaagacaauuccauccgccuuucugcuggaggcgauauuugggugacaagagagccuuauguuagcugugacccggauaagugcuaccaauucgcccuggggcagggaaccacacucaacaauggccauuccaacgacaucgugcacgaucggacccccuaucgcacgcugcugaugaaugaacucggggucccuuuucaucugggaacaaaacagguguguaucgccuggucuagcuccagcugccacgacggcaaggcuuggcuucauguuugugugaccggcgaugacgagaacgccacagcuucuuucauuuacaaugggagacuggucgauuccaucggaagcuggucuaagaaaauucuccggacccaggaauccgagugcguguguaucaacgggaccugcacaguggucaugacggacggcagcgccucuggaaaggcggauaccaaaauucuguuuaucgaggaaggcaagaucguucacacaucccuucugagcggguccgcccaacacguggaggaaugcucuuguuauccccgcuacccuggagugagaugcgucugucgggacaacuggaagggcagcaaucgccccauuguggauaucaacguuaaagacuacuccauugugagcucuuaugucugcuccggccucgugggggacaccccgagaaagaaugauagcucuagcuccucucauugucuggacccuaacaaugaggaaggaggccacgggguuaaaggaugggcuuucgaugacggcaacgauguguggauggggcggacaaucagcgagaagcugcgcuccggauacgagaccuuuaaagucauugaaggcuggagcaagcccaauucuaaacuccagaucaacagacaggugaucgucgaccggggcaaucgcuccggguauagcggaauuuucucuguggagggcaaguccugcaucaacagauguuuuuacguugaacugauucgggggagaaagcaggagacggaagugcuuuggacaagcaauuccaucgucguguucugcggaaccucuggcaccuaugggacaggcagcuggccugauggagccgacauuaaccugaugcccaucuga

SEQ ID NO: 198887 - RNA, 1410 nt, Artificial Sequence; identical to SEQ ID NO: 197754
  derived and/or modified sequence opt5 from neuraminidase__InfluenzaA__ABS50034

SEQ ID NO: 198888 - RNA, 1410 nt, Artificial Sequence
  derived and/or modified sequence opt5 from neuraminidase__InfluenzaA__ABS50045
augaaccccaaucagaagaucauuaccaucggcagcgugucccugacaauugccacgaucugcuuccucaugcaaaccgcuauucuggucacaaccguuacacuucacuuuaaacaguacgaguguaacucuccuccgaauaaccaggugaugcugugcgaacccaccaucaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgauccacgaucggacaccguaucgcacccugcugaugaaugaacucgggguucccuuucaucugggaacaagacagguguguaucgccuggagcuccagcucuugccacgacggcaaggcuuggcuucaugucugugugaccggcgaugacgagaacgccaccgcuuccuucauuuacaaugggcggcugguugauagcaucggaucuugguccaaaaagauucuccgcacacaggaaagcgagugcguguguaucaacggcacgugcaccgucgugaugacagacgggucugccuccggaaaagcggauaccaagauucuguuuaucgaggaaggcaaaaucgugcacauuagcacacuuuccgggucugcccaacacgucgaggaaugcagcuguuauccuagauaccccggaguucggugcgugugucgcgacaacuggaagggcuccaauagaccuaucguggauauuaacgucaaggacuacagcaucgugucuuccuauguuugcagcggccuggugggggacacgccccggaaaaaugauucuuucagcuccucucauugucucgacccgaacaaugaggaaggaggccacggggucaagggaugggcuuuugaugacggcaacgauguguggauggggcgcaccauuagcgagaaacugagauccggauacgagacauucaagguuaucgaaggcuggagcaaaccuaauucuaagcugcagaucaaccgccaggugauugucgagcggggcaauagauccggguauagcggaaucuuuucuguggaaggcaaauccugcauuaaccgguguuucuacgucgagcucaucagagggcgcaaggaagagaccgaggugugguggaccagcaauuccauuguuguguuuugcggaacaucuggcaccuaugggacaggcagcuggcccgacggagccgauaucaaccugaugccuauuuga

SEQ ID NO: 198889 - RNA, 1410 nt, Artificial Sequence; identical to SEQ ID NO: 197178
  derived and/or modified sequence opt5 from neuraminidase__InfluenzaA__ABS50056

SEQ ID NO: 198890 - RNA, 1410 nt, Artificial Sequence; identical to SEQ ID NO: 197204
  derived and/or modified sequence opt5 from neuraminidase__InfluenzaA__ABS50067

SEQ ID NO: 198891 - RNA, 1410 nt, Artificial Sequence; identical to SEQ ID NO: 197738
  derived and/or modified sequence opt5 from neuraminidase__InfluenzaA__ABS50078

SEQ ID NO: 198892 - RNA, 1413 nt, Artificial Sequence
  derived and/or modified sequence opt5 from neuraminidase__InfluenzaA__ABS71644
augaagcccaaccagaaaaucauuaccaucggcagcauuuccaucgccauugggaucaucucucugauucuccaaaucggaaauauuaucagcauuugggcuucccacucuauccagacagagagccagaaccauacgggcauuugcaaucagagaaucaucaccuacgaaaacuccacaugggugaauaacaccuaugucaauauuaacaauacaaacguuguggccgagaaggacaaaaccucugugacacuggcggggaauagcucccuuuguagcaucucuggaugggcuauuuacaccaaggauaacuccauccggauuggcagcaaaggggacgucuucgugauccgcgaaccuuuuaucucuugcucccaccuggaguguagaacguucuuucucacccaaggagcccugcuuaaugauaagcauagcaacggcacaguuaaggaccggucuccguaucgcgcccugauguccugcccccucggcgaagcuccuagccccuacaauuccagauucgagucuguggccuggagcgcuuccgccugucacgaugggaugggauggcugaccauuggcaucagcgggccugacaacggagcggucgccgugcugaaauauaacggcauuaucacagagaccauuaagucuuggaaaaagcggauccuccgcacgcaggaauccgagugcguuuguaugaaugggagcugcuuuacaaucaugaccgauggacccucuaacggcgcugccagcuacaaaauuuucaagaucgaaaagggcaaagugacaaagaccauggagcugaaugcuccuaacuuucauuaugaggaauguuccugcuacccggacaccgggacagucaugugugugugcagagauaauuggcacggaucuaaccggcccugggugagcuucaaucagaaccuugacuaccagauuggcuauaucugcuccggggucuuuggagauaauccucgccccaaagacggcgaggggagcuguaacccuguuacgguggauggagccgacggcgugaagggcuucucuuacaaauaugggaauggagucuggaugggcagaaccaaguccaaccggcugcgcaaaggguuugaaaugauuugggaccccaauggauggacaaacaccgauagcgacuucucugugaagcaagauguuguggcgaucacagacugguccggcuacagcggguccuuuguccagcacccggagcucaccggccuggauugcauuagaccuuguuucuggguggaacuuguucggggacugccccgcgagaauacgacaaucuggaccucuggcagcuccaucucuuucugcggggugaacagcggaaccgccaacugguccuggccugacggcgcugagcuccccuuuacaauugauaaguga

SEQ ID NO: 198893 - RNA, 1413 nt, Artificial Sequence
  derived and/or modified sequence opt5 from neuraminidase__InfluenzaA__ABS71646
augaaccccaaucagaagaucauuaccaucggcagcauuuccaucgccauugggaucaucucucugauucuccaaaucggaaacauuaucagcauuugggcuucccacucuauccagacagagagccagaaucauacgggcauuugcaaccagagaaucaucaccuacgaaaauuccacaugggugaacaauaccuaugucaacauuaauaacacaaauguuguggccgagaaagacaagaccucugugacacuggcggggaacagcucccuuuguagcaucucuggaugggcuauuuacaccaaagauaauuccauccggauuggcagcaagggggacgucuucgugauccgcgaaccuuuuaucucuugcucccaccuggaguguagaacguucuuucucacccaaggagcccugcuuaacgauaaacauagcaauggcacaguuaaggaccggucuccguaucgcgcccugauguccugcccccucggcgaagcuccuagccccuacaacuccagauucgagucuguggccuggagcgcuuccgccugucacgaugggaugggauggcugaccauuggcaucagcgggccugacaacggagcggucgccgugcugaaguauaauggcauuaucacagagaccauuaaaucuuggaagaaacggauccuccgcacgcaggaauccgagugcguuuguaugaacgggagcugcuuuacaaucaugaccgauggacccucuaauggcgcugccagcuacaagauuuucaaaaucgaaaagggcaaggugacaaaaaccauggagcugaacgcuccuaauuuucauuaugaggaauguuccugcuacccggacaccgggacagucaugugugugugcagagauaacuggcacggaucuaaucggcccugggugagcuucaaccagaaucuugacuaccagauuggcuauaucugcuccggggucuuuggagauaacccucgccccaaggacggcgaggggagcuguaauccuguuacgguggauggagccgacggcgugaaaggcuucucuuacaaguaugggaacggagucuggaugggcagaaccaaauccaaucggcugcgcaagggguuugaaaugauuugggaccccaacggauggacaaauaccgauagcgacuucucugugaaacaagauguuguggcgaucacagacugguccggcuacagcggguccuuuguccagcacccggagcucaccggccuggauugcauuagaccuuguuucuggguggaacuuguucggggacugccccgcgagaacacgacaaucuggaccucuggcagcuccaucucuuucugcggggugaacagcggaaccgccaauugguccuggccugacggcgcugagcuccccuuuacaauugauaaguga

SEQ ID NO: 198894 - RNA, 1413 nt, Artificial Sequence
  derived and/or modified sequence opt5 from neuraminidase__InfluenzaA__ABS71647
augaaccccaaucagaagaucauuaccaucggcagcauuuccaucgccauugggaucaucucucugauucuccaaaucggaaacauuaucagcauuugggcuucccacucuauccagacagagagccagaaucauacgggcauuugcaaccagagaaucaucaccuacgaaaauuccacaugggugaacaauaccuaugucaacauuaauaacacaaauguuguggccgagaaagacaagaccucugugacacuggcggggaacagcucccuuuguagcaucucuggaugggcuauuuacaccaaagauaauuccauccggauuggcagcaagggggacgucuucgugauccgcgaaccuuuuaucucuugcucccaccuggaguguagaacguucuuucucacccaaggagcccugcuuaacgauaaacauagcaauggcacaguuaaggaccggucuccguaucgcgcccugauguccugcccccucggcgaagcuccuagccccuacaacuccagauucgagucuguggccuggagcgcuuccgccugucacgaugggaugggauggcugaccauuggcaucagcgggccugacaacggagcggucgccgugcugaaguauaauggcauuaucacagagaccauuaaaucuuggcggaagcgcauccucagaacgcaggaauccgagugcguuuguaugaacgggagcugcuuuacaaucaugaccgauggacccucuaauggcgcugccagcuacaaaauuuucaagaucgaaaaaggcaaggugacaaagaccauggagcugaacgcuccuaauuuucauuaugaggaauguuccugcuacccggacaccgggacagucaugugugugugccgggauaacuggcacggaucuaaucgccccugggugagcuucaaccagaaucuugacuaccagauuggcuauaucugcuccggggucuuuggagauaacccuagacccaaagacggcgaggggagcuguaauccuguuacgguggauggagccgacggcgugaagggcuucucuuacaaauaugggaacggagucuggaugggccggaccaaguccaaucgccugagaaaaggguuugaaaugauuugggaccccaacggauggacaaauaccgauagcgacuucucugugaagcaagauguuguggcgaucacagacugguccggcuacagcggguccuuuguccagcacccggagcucaccggccuggauugcauucggccuuguuucuggguggaacuuguucgcggacugcccagagagaacacgacaaucuggaccucuggcagcuccaucucuuucugcggggugaacagcggagccgcuaauugguccuggccugacggcgccgagcuccccuuuaccauugauaaauga

SEQ ID NO: 198895 - RNA, 1413 nt, Artificial Sequence
  derived and/or modified sequence opt5 from neuraminidase__InfluenzaA__ABS71648
augaaccccaaucagaagaucauuaccaucggcagcauuuccaucgccauugggaucaucucucugauucuccaaaucggaaacauuaucagcauuugggcuucccacucuauccagacaggcaaucagaaccauacggggauuugcaaucagagaaucaucaccuacgagaacagcacaugggugaauaacaccuaugugaauauuaacaauacaaacguuguggccgaaaaagacaagaccuccgugacacuggcgggaaauucuagccuuuguuccaucagcggcugggcuauuuacaccaaagauaacucuauccggauuggguccaagggagacgucuucgugauccgcgagccuuuuaucagcugcucucaccuggaauguagaacguucuuucucacccaaggcgcccugcuuaaugauaaacauuccaacggcacaguuaaggaccggagcccguaucgcgcccugaugucuugcccccucggggaggcuccuucccccuacaacagcagauucgaauccguggccuggucugcuagcgccugucacgauggaaugggcuggcugaccauugggaucuccggaccugacaauggcgcggucgccgugcugaaguauaacgggauuaucacagagaccauuaaaagcuggaagaaacggauccuccgcacgcaggagucugaaugcguuuguaugaauggauccugcuuuacaaucaugaccgauggccccagcaacggcgcugccucuuacaagauuuucaaaaucgagaaggggaaggugacaaaaaccauugaacugaaugcuccuaacuuucauuaugaggaguguagcugcuacccggacaccggaacagucaugugugugugcagagauaauuggcacggcuccaaccggcccugggugucuuucaaucagaaccuugacuaccagaucggguauauuugcagcggagucuuuggcgauaauccucgccccaaggacggggaaggauccuguaacccuguuacgguggauggcgccgacggcgugaaaggguucagcuacaaguauggaaauggcgucuggaucgggagaaccaaaucuaaccggcugcgcaagggauuugagaugauuugggaccccaauggcuggacaaacaccgauuccgacuucagcgugaaacaagauguuguggcgaucacagacuggucuggguacuccggcagcuuuguccagcacccggaacucaccggacuggauugcaucagaccuuguuucuggguggagcuuguucggggccugcccaaggaaaacacgacaauuuggaccuccgggucuagcaucuccuucugcggagucaauucuggcaccgccaacuggagcuggccugacggggcugagcuccccuuuacaauugauaaguga

SEQ ID NO: 198896 - RNA, 1413 nt, Artificial Sequence
  derived and/or modified sequence opt5 from neuraminidase__InfluenzaA__ABS71649
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccgagaaagacaagaccucugugacacuggcgggaaauagcucccuuuguagcauuucuggcugggcuaucuacaccaaagauaacuccauucggaucgggagcaagggagacgucuucgugauucgcgagccuuuuaucucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggauuagcggaccugacaacggcgcggucgccgugcugaaauauaacgggaucauuacaggaaccaucaagucuuggaaaaagcagauucucagaacgcaggaguccgagugcguuuguaugaauggcagcugcuuuacaaucaugaccgauggccccucuaaccgggcugccagcuacaaaaucuucaagauugaaaaggggaaagugacaaaguccaucgagcugaaugcuccuaacuuucacuaugaagaguguucuugcuacccggacaccggaauugucaugugugugugccgcgauaauuggcacggcagcaacagacccuggguguccuucaaucagaaccuugacuaccaaaucggguauauuugcagcggagucuuuggcgauaauccucggcccaaagacggggagggaucuuguaacccuguuaccguggauggcgccgacggcgugaagggguucuccuacaaauaugacaauggagucuggaucggccgcacaaagagcaacagacugcggaaaggguuugaaaugauuugggaucccaauggauggacgaacaccgacucugauuucuccgugaagcaggacguuguggcgaucacagauuggagcggcuacuccgggucuuuuguccagcauccggagcucaccggccuggacugcauccgcccuuguuucuggguggaacuuguuagaggacugccccgggagaauacaaccauuuggacgagcggcuccucuaucagcuucugcggggugaacuccgauacagccaacuggagcuggccugacggagcugaacuccccuuuaccauugauaaguga

SEQ ID NO: 198897 - RNA, 1413 nt, Artificial Sequence
  derived and/or modified sequence opt5 from neuraminidase__InfluenzaA__ABS71651
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauguuguggccggaaaagacaagaccuccgugacacuggcgggcaacucuagccuuuguuccgucagcgggugggcuauuuacaccaaagauaauucuauccggauuggauccaagggcgacguguucguuauccgcgaaccuuuuauuagcugcucucaucuggaguguagaacguucuuucucacccaaggcgcccugcuuaacgauaaacacuccaaugggacagugaaggaccggagcccguaucgcgcccugaugucuugcccccucggagaagcuccuucccccuacaacagcaaguucgaguccgucgccuggucugcuagcgccugucaugauggcaugggguggcugaccaucggaaucuccggcccugacaacggggcgguggccguucugaaauauaauggaauuaucacaggcaccauuaagagcuggaaaaagagaauccuccggacgcaggaaucugagugcguguguaugaacggcuccugcuuuacaauuaugaccgaugggcccagcaauggagcugccucuuacaaaaucuucaagaucgagaagggcaaagucacaaagagcauugaacugaacgcuccuuccuuucacuaugaggaauguucuugcuacccggacaccgggaccgugaugugugugugccgcgauaauuggcacggaagcaacagacccugggucuccuucaaucagaaccuugacuaccagaucggcuauauuugcagcgggguuuuuggagauaauccucggcccaaagacggcgagggcucuuguaacccugugacaguggauggggccgacggagucaagggcuucuccuacaaauaugggaauggaguguggcugggccgcaccaagagcaacagacuccggaaaggguuugagaugaucugggaccccaauggcuggacgaacacagauucugacuucuccguuaagcaagauguggucgcgauuaccgacuggagcggauacuccggcucuuuugugcagcauccggaacugacagggcuugauugcauccgcccuuguuucuggguugagcuggugagaggacucccccgggaaaauaccacgauuuggacaagcggcuccucuaucagcuucugcggggucaacuccaacaccgccaauuggagcuggccugacggagcugagcugcccuuuaccaucgauaaguga

SEQ ID NO: 198898 - RNA, 1413 nt, Artificial Sequence
  derived and/or modified sequence opt5 from neuraminidase__InfluenzaA__ABS71652
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauguuguggccggaaaagacaagaccuccgugacacuggcgggcaacucuagccuuuguuccgucagcgggugggcuauuuacaccaaagauaauucuauccggauuggauccaagggcgacguguucguuauccgcgaaccuuuuauuagcugcucucaucuggaguguagaacguucuuucucacccaaggcgcccugcuuaacgauaaacacuccaaugggacagugaaggaccggagcccguaucgcgcccugaugucuugcccccucggagaagcuccuucccccuacaacagcaaguucgaguccgucgccuggucugcuagcgccugucaugauggcaugggguggcugaccaucggaaucuccggcccugacaacggggcgguggccguucugaaauauaauggaauuaucacagaaaccauuaagagcuggaaaaagagaauccuccggacgcaggagucugagugcguguguaugaacggcuccugcuuuacaauuaugaccgauggccccagcaauggggcugccucuuacaaaaucuucaagaucgaaaagggaaaagucacaaagagcauugagcugaacgcuccuuccuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaagacggagagggcucuuguaacccugugacaguggauggcgccgacggggucaagggauucuccuacaaauauggcaaugggguguggaucggacgcaccaagagcaacagacugcggaaaggcuuugaaaugauuugggaccccaauggguggacgaacacagauucugacuucuccguuaagcaagauguggucgcgaucaccgacuggagcggcuacuccggaucuuuugugcagcauccggagcucacaggccuggauugcauucgcccuuguuucuggguugaacuugugagagggcugccccgggagaauaccacgaucuggacaagcggauccucuaucagcuucugcggcgucaacuccaacaccgccaauuggagcuggccugacggggcugaacuccccuuuaccauugauaaguga

SEQ ID NO: 198899 - RNA, 1413 nt, Artificial Sequence
  derived and/or modified sequence opt5 from neuraminidase__InfluenzaA__ABS71653
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugaugaucugcccccucggagaagcuccuucccccuacaauagcaaguucgaguccguggccuggucugcuagcgccugucaugauggcaugggguggcugaccauuggaaucuccggcccugacaacggggcggucgccgugcugaaauauaacggaauuaucacagaaaccauuaagagcuggaaaaagagaauccuccggacgcaggagucugagugcguuugugugaauggcuccugcuuuacaaucaugaccgauggccccagcaacggggcugccucuuacaaaauuuucaagaucgaaaagggaaaagucacaaagagccgcgagcugaaugcuccuaacuuucacuaugaagaguguuccugcuacccggacauuggcaccgugaugugugugugcagagauaauuggcacgggucuaaccggcccugggucagcuucaaucagaaccuugacuaccagaucggauauauuugcuccggcguuuuuggggauaauccucgccccaaagacggaaagggcagcuguaacccugugaccgccgauggcgcggacggggugaaaggauucucuuacaaguauggcaauggggucuggaucggaagaacaaaauccaaccggcugcgcaagggcuuugagaugauuugggaccccaauggguggacggauaccgacagcgauuucucugugaagcaagacguuguggccaucacagauugguccggcuacagcggauccuuuguccagcauccggaacucaccggccuggacugcaucagaccuuguuucuggguggagcuuguucgggggcugccccgcgaaaacacaaccauuuggacgucuggaagcuccaucucuuucugcggcguggauagcgacacagcuaauugguccuggccugauggggccgagcuccccuuuaccauugacaaauga

SEQ ID NO: 198900 - RNA, 1410 nt, Artificial Sequence
  derived and/or modified sequence opt5 from neuraminidase__InfluenzaA__ABS71655
augaaccccaucaagaaaauuaucaccauuggcagcgugucccugacaaucucuacgauuugcuucuuuaugcagaucgccauccucauuaccacagucacccugcacuucaagcaauacgaguuuaauagcccuccgaacaaucagguuaugcuuugugaacccacaaucauugagagaaacaucaccgaaauuguguaucugacaaauaccacgaucgagaaagaaauuugcccuaagcucgcugaguaccggaacugguccaaaccccaguguaauaucaccggguucgccccuuuuucuaaggacaacagcauccgccuguccgcgggaggcgauauuugggugacaagagagcccuaugucucuugcgacccugauaaguguuaccaguucgcucuugggcaaggaaccacacugaauaacgugcauagcaaugacaccguucacgaucggacgccguaucgcacacuccugaugaacgaacugggcgugcccuuucaucucgggaccaaacaggucugcaucgccugguccucuagcuccugucacgacggaaaggccuggcugcaugugugcguuacaggcgaugacaaaaaugcuaccgccagcuucauuuacaacggcagacuuguggauucuaucgucuccuggagcaaggagauucugcggacccaggaaucugagugugugugcaucaaugggacauguacgguggucaugaccgacggauccgcuagcggcaaagccgauacaaagauccucuuuauugaggaagggaagaucguucacaccuccacacugucuggaagcgcgcagcacguggaggaaugcuccugcuauccucgcuaccccggcgugagaugugucugccgggacaacuggaaagggagcaaccgcccuauuguggauaucaauauuaaggacuacucuaucguuuccagcuauguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucagcgagaaacuccgcucuggcuacgagacauuuaaggugauugaagggugguccaacccuaauagcaaacugcaaaucaacagacaggucauuguggaccggggaaaucgcucuggcuauuccggcaucuucagcgucgaggggaaguccuguauuaacagaugcuuuuacguggaacugauccggggaagaaaggaggaaaccgagguucucuggaccucuaauagcauuguggucuucuguggcacauccgggaccuauggaacaggcucuuggcccgauggggcugacaucaaccugaugccuaucuga

SEQ ID NO: 198901 - RNA, 1410 nt, Artificial Sequence
  derived and/or modified sequence opt5 from neuraminidase__InfluenzaA__ABS71657
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacgccccggaagaaugacagcuccucuagcucccauugccuggauccgaacaaugaggaaggcgggcacggagugaaaggcugggccuucgacgaugggaacgacgcuuggaugggacgcaccaucagcgagaagucuagauccggcuacgagacauuuaaaguuaucgaaggguggagcaauccuaacucuaagcuccagauuaaucgccaggugaucgucgaucggggaaacagauccggcuauagcggcauuuucuccguggaggggaaaucuuguaucaaucggugcuuuuacgucgaacugauuagaggacgcaaggaggaaaccgaggugcuguggaccagcaacuccaucguuguguucuguggcacaucugggaccuauggaacaggcagcuggcccgacggggccgauauuaaucucaugccuaucuga

SEQ ID NO: 198902 - RNA, 1410 nt, Artificial Sequence
  derived and/or modified sequence opt5 from neuraminidase__InfluenzaA__ABS71659
augaaccccaucaagaaaauuaucaccauuggcagcgugucccugacaaucucuacgauuugcuucuuuaugcagaucgccauccucauuaccacagucacccugcacuucaagcaauacgaguuuagcuccccuccgaauaaccagguuaugcuuugugaacccacaaucauugagagaaauaucaccgaaauuguguaucugacaaacaccacgaucgagaaagaaauuugcccuaagcucgcugaguaccggaauuggucuaaaccccagugugacaucaccggguucgccccuuuuagcaaggauaacuccauccgccugucugcgggaggcgacauuugggugacaagagagcccuaugucagcugcgauccugacaaguguuaccaguucgcucuugggcaaggaaccacacugaauaacgugcauuccaaugauaccguucacgaccggacgccguaucgcacacuccugaugaacgaacugggcgugcccuuucaucucgggaccaaacaggucugcaucgccuggucuagcuccagcugucacgauggaaaggccuggcugcaugugugcguuacaggcgacgauaaaaaugcuaccgccucuuucauuuacaacggcagacuuguggacuccaucgucagcuggucuaaggagauucugcggacccaggaauccgagugugugugcaucaaugggacauguacgguggucaugaccgauggaagcgcuuccggcaaagccgacacaaagauccucuuuauugaggaagggaagaucguucacaccucuacacugagcggauccgcgcagcacguggaggaaugcagcugcuauccucgcuaccccggcgugagaugugucugccgggauaacuggaaagggucuaaucgcccuauuguggacaucaacauuaaggacuacuccaucguuagcagauauguguguucuggacuugucggcgauacgccccggaaaaacgacagcuccucuagcucccauugccuggauccgaauaacgaggaaggcgggcacggagugaagggcugggccuucgacgaugggaaugacguuuggaugggacgcaccaucggcgagaaaagcagaucuggguacgagacauuuaaggugauugaaggaugguccaacccuaauagcaaacuccaaaucaaccggcaggucauuguggaucgcggcaauagaucuggcuauuccgggaucuucagcgucgagggaaaguccuguauuaaccggugcuuuuacguggaacugaucagaggccgcaaggaggaaaccgagguucuguggaccucuaauagcauuguggucuucugugggacauccggaaccuauggcacagggucuuggcccgacggcgcugauaucaaccauaugccuaucuga

SEQ ID NO: 198903 - RNA, 1410 nt, Artificial Sequence
  derived and/or modified sequence opt5 from neuraminidase__InfluenzaA__ABS71660
augaaccccaucaagaaaauuaucaccauuggcagcgugucccugacaaucucuacgauuugcuucuuuaugcagaucgccauccucauuaccacagucacccugcacuucaagcaauacgaguuuagcuccccuccgaauaaccagguuaugcuuugugaacccacaaucauugagagaaauaucaccgaaauuguguaucugacaaacaccacgaucgagaaagaaauuugcccuaagcucgcugaguaccggaauuggucuaaaccccagugugacaucaccggguucgccccuuuuagcaaggauaacuccauccgccugucugcgggaggcgacauuugggugacaagagagcccuaugucagcugcgauccugacaaguguuaccaguucgcucuugggcaaggaaccacacugaauaacgugcauuccaaugauaccguucacgaccggacgccguaucgcacacuccugaugaacgaacugggcgugcccuuucaucucgggaccaaacaggucugcaucgccuggucuagcuccagcugucacgauggaaaggccuggcugcaugugugcguuacaggcgacgauaaaaaugcuaccgccucuuucauuuacaacggcagacuuguggacuccaucgucagcuggucuaaggagauucugcggacccaggaauccgagugugugugcaucaaugggacauguacgguggucaugaccgauggaagcgcuuccggcaaagccgacacaaagauccucuuuauugaggaagggaagaucguucacaccucuacacugagcggauccgcgcagcacguggaggaaugcagcugcuauccucgcuaccccggcgugagaugugucugccgggauaacuggaaagggucuaaucgcccuauuguggacaucaacauuaaggacuacuccaucguuagcagauauguguguucuggacuugucggcgauacgccccggaaaaacgacagcuccucuagcucccauugccuggauccgaauaacgaggaaggcgggcacggagugaagggcugggccuucgacgaugggaaugacguuuggaugggacgcaccaucagcgagaaaucuagauccggcuacgagacauuuaaggugauugaaggguggagcaacccuaauucuaaacuccaaaucaaccggcaggucauuguggaucgcggaaauagauccggcuauagcggcaucuucuccgucgaggggaagucuuguauuaaccggugcuuuuacguggaacugaucagaggacgcaaggaggaaaccgagguucuguggaccagcaauuccauuguggucuucuguggcacaucugggaccuauggaacaggcagcuggcccgacggggcugauaucaaccucaugccuaucuga

SEQ ID NO: 198904 - RNA, 1410 nt, Artificial Sequence
  derived and/or modified sequence opt5 from neuraminidase__InfluenzaA__ABS71661
auguaccccaucaagaaaauuaucaccauuggcagcgugucccugacaaucucuacgauuugcuucuuuaugcagaucgccauccucauuaccacagucacccugcacuucaagcaauaugaguuuagcuccccuccgaacaaucagguuaugcuuugugaacccacaaucauugagagaaacaucaccgaaauuguguaccugacaaauaccacgaucgagaaagaaauuugcccuaagcucgcugaguaucggaacuggucuaaaccccagugugacaucaccggguucgccccuuuuagcaaggauaauuccauccgccugucugcgggaggcgacauuugggugacaagagagcccuacgucagcugcgauccugacaaguguuaucaguucgcucuugggcaaggaaccacacugaacaaugugcauuccaacgauaccguucacgaccggacgccguaccgcacacuccugaugaaugaacugggcgugcccuuucaucucgggaccaaacaggucugcaucgccuggucuagcuccagcugucacgauggaaaggccuggcugcaugugugcguuacaggcgacgauaaaaacgcuaccgccucuuucauuuauaauggcagacuuguggacuccaucgucagcuggucuaaggagauucugcggacccaggaauccgagugugugugcaucaacgggacauguacgguggucaugaccgauggaagcgcuuccggcaaagccgacacaaagauccucuuuauugaggaagggaagaucguucacaccucuacacugagcggauccgcgcagcacguggaggaaugcagcugcuacccucgcuaccccggcgugagaugugucugccgggauaauuggaaagggucuaaccgcccuauuguggacaucaauauuaaggacuauuccaucguuagcagauacguguguucuggacuugucggcgauacgccccggaaaaacgacagcuccucuagcucccauugccuggauccgaacaaugaggaaggcgggcacggagugaagggcugggccuucgacgaugggaacgacguuuggaugggacgcaccaucagcgagaaaucuagauccggcuaugagacauuuaaggugauugaaggguggagcaauccuaacucuaaacuccaaaucaaucggcaggucauuguggaucgcggaaacagauccggcuacagcggcaucuucuccgucgaggggaagucuuguauuaaucggugcuuuuauguggaacugaucagaggacgcaaggaggaaaccgagguucuguggaccagcaacuccauuguggucuucuguggcacaucugggaccuacggaacaggcagcuggcccgacggggcugauaucaaucucaugccuaucuga

SEQ ID NO: 198905 - RNA, 1410 nt, Artificial Sequence
  derived and/or modified sequence opt5 from neuraminidase__InfluenzaA__ABS71662
augaaccccaucaagaaaauuaucaccauuggcagcgugucccugacaaucucuacgauuugcuucuuuaugcagaucgccauccucauuaccacagucacccugcacuucaagcaauacgaguuuaauagcccuccgaacaaucagguuaugcuuugugaacccacaaucauugagagaaacaucaccgaaauuguguaucugacaaauaccacgaucgagaaagaaauuugcccuaagcucgcugaguaccggaacugguccaaaccccagugugacaucaccggguucgccccuuuuucuaaggauaauagcauccgccuguccgcgggaggcgacauuugggugacaagagagcccuaugucucuugcgauccugacaaguguuaccaguucgcucuugggcaaggaaccacacugaacaaugugcauagcaacgauaccguucgggaccgcacgccguauagaacacuccugaugaaugaacugggcgugcccuuucaccucgggaccaaacaggucugcaucgccugguccucuagcuccugucaugauggaaaggccuggcugcacgugugcauuacaggcgacgauaaaaacgcuaccgccagcuucaucuacaauggccggcuuguugacucuauuguguccuggagcaaggagauccugcgcacccaggaaucugagugugucugcaucaacgggacauguacgguggugaugaccgauggauccgcuagcggcaaagccgacacaaagauucucuuuaucgaggaagggaagauuguccauaccuccacacugucuggaagcgcgcagcacguugaggaaugcuccugcuauccuagauaccccggcgugcggugugugugccgcgauaauuggaaagggagcaacagaccuaucgucgacauuaacaucaaggaccacucuaucguguccagcuacguuuguucuggacuugugggcgauacgccccggaaaaaugacagcuccucuagcucccauugccuggauccgaacaaugaggaaggcgggcacggagucaagggcugggccuucgacgaugggaacgacguguggaugggacgcaccauuagcgagaaaucuagacucggcuaugagacauuuaagguuaucgaagggugguccaauccuaacagcaaacugcaaauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggaccucuaacagcaucguuguguucuguggcacauccgggaccuacggaacaggcucuuggcccgacggggcugauaucaaucugaugccuauuuga

SEQ ID NO: 198906 - RNA, 1410 nt, Artificial Sequence
  derived and/or modified sequence opt5 from neuraminidase__InfluenzaA__ABS71663
auguaccccaucaagaaaauuaucaccauuggcagcgugucccugacaaucucuacgauuugcuucuuuaugcagaucgccauccucauuaccacagucacccugcacuucaagcaauaugaguuuaacagcccuccgaauaaccagguuaugcuuugugaacccacaaucauugagagaaauaucaccgaaauuguguaccugacaaacaccacgaucgagaaagaaauuugcccuaagcucgcugaguaucggaauugguccaaaccccagugugacaucaccggguucgccccuuuuucuaaggauaacagcauccgccuguccgcgggaggcgacauuugggugacaagagagcccuacgucucuugcgauccugacaaguguuaucaguucgcucuugggcaaggaaccacacugaauaacgugcauagcaaugauaccguucgggaccgcacgccguacagaacacuccugaugaacgaacugggcgugcccuuucaccucgggaccaaacaggucugcaucgccugguccucuagcuccugucaugauggaaaggccuggcugcacgugugcauuacaggcgacgaucagaaugcuaccgccagcuucaucuauaacggccggcuuguugacucuauuguguccuggagcaaagagauccugcgcacccaggaaucugagugugucugcaucaaugggacauguacgguggugaugaccgauggauccgcuagcggcaaggccgacacaaaaauucucuuuaucgaggaagggaagauuguccauaccuccacacugucuggaagcgcgcaacacguugaggaaugcuccugcuacccuagauaccccggcgugcggugugugugccgcgauaacuggaaggggagcaauagaccuaucgucgacauuaacaucaaagaccacucuaucguguccagcuauguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccauuagcgagaagucuagacucggcuacgagacauuuaaaguuaucgaagggugguccaacccuaauagcaagcugcagaugaaccgccaggugauugucgaucggggaaauagaucuggcuauuccggcaucuucagcguggaggggaaauccuguauuaaccggugcuuuuacgucgaacugaucagaggacgcaaggaggaaaccgaggugcucuggaccucuaauagcauuguuguguucuguggcacauccgggaccuauggaacaggcucuuggcccgacggggcugauaucaaccugaugccuaucuga

SEQ ID NO: 198907 - RNA, 1410 nt, Artificial Sequence
  derived and/or modified sequence opt5 from neuraminidase__InfluenzaA__ABU40956
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaauuguuaccaauucgcucuugggcagggaaccacacugaacaaugugcauagcaacgauaccguucgggaccgcacgccguauagaacacuccugaugaaugaacugggcgugcccuuucaccucgggaccaagcaggucugcauugccugguccucuagcuccugucaugauggaaaggccuggcugcacgugugcaucacaggcgacgauaaaaacgcuaccgccagcuucauuuacaauggccggcuuguugacucuaucguguccuggagcaaggagauucugcgcacccaggaaucugagugugucugcaucaacgggacauguacgguggugaugaccgauggauccgcuagcggcaaagccgacacaaagauccucuuuauugaggaagggaaaaucguccauaccuccacacugucuggaagcgcgcaacacguugaggaaugcuccugcuauccuagauaccccggcgugcggugugugugccgcgauaacuggaaggggagcaauagaccuauuaucgacauuaacaucaaggaccacucuaucgucuccagcuacguguguucuggacuuguuggcgauacgccccggaaaaaugacagcuccucuagcucccauugccuggauccgaacaaugaggaaggcgggcacggagugaagggcugggccuucgacgaugggaacgacgucuggaugggacgcaccauuagcgagaaaucuagacucggcuaugagacauuuaaggugaucgaagggugguccaauccuaaaagcaagcugcagauuaaccggcagguuaucguggaucgcggaaauagaucuggcuacuccggcauuuucagcgucgaggggaaauccuguaucaaccggugcuuuuauguggaacugauuagaggacgcaaggaggaaaccgagguccucuggaccucuaauagcaucgugguuuucuguggcacauccgggaccuacggaacaggcucuuggcccgacggggcugauaucaaccugaugccuauuuga

SEQ ID NO: 198908 - RNA, 1410 nt, Artificial Sequence
  derived and/or modified sequence opt5 from neuraminidase__InfluenzaA__ABU50651
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggcccgacggggcugauaucaaucugaugccuaucuga

SEQ ID NO: 198909 - RNA, 1410 nt, Artificial Sequence
  derived and/or modified sequence opt5 from neuraminidase__InfluenzaA__ABU80180
augaaccccaaucagaagaucauuaccaucggcagcgugucccugacaauugccacgaucugcuuccucaugcaaauugcuauccuggucaccacaguuacccuucacuuuaaacaguacgaguguaacucuuucccuaauaaccaggugaugcugugcgaaccgacaaucauugagagaaauaucaccgaaauuguguaucucacaaacaccacgaucgagaaggaaauuugucccaaacuggccgaguaccggaauuggagcaagccucagugcaacaucaccggguuugcgcccuucuccaaagacaauucuauucgccuuagcgcuggaggcgauaucugggucacaagagagccuuauguguccugugaccccgauaagugcuaccaauuugcccuggggcagggaaccacacucaacaauggccauucuaacgacaccguucacgaucggacgccuuaucgcacacugcugaugaaugaacucggggugccguuccaucugggaaccaagcaggucuguaucgccuggagcuccagcucuugccacgacggcaaagccuggcuucauguguguguuacaggcgaugacgagaacgcuaccgcuuccuuuauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguucaucgaggaaggcaagaucguccacaccagcucccuuucugggagcgcccaacacguugaggaaugcuccuguuauccccgcuacccuggagugagaugcgugugucgggacaacuggaagggcagcaaucgccccauugucgauaucaacgugaaagacuacucuauuguuuccagcuaugugugcucuggccuggucggggacacaccuagaaagaaugauagcuccucuagcucccauugucucgaccccaacaaugaggaaggaggccacggggugaaaggaugggcuuuugaugacggcaacgauguuuggauggggcggaccaucagcgagaagcugcgcucuggauacgagacguucaaagugauugaaggcugguccaagccgaauagcaaacugcagaucaacagacaggucaucguggaccggggcaaucgcucuggguauuccggaauuuuuagcgucgagggcaaguccugcaucaacagauguuucuacguggaacucauucgggggagaaagcaggagacagaaguucuguggaccucuaauagcaucguggucuuuugcggaaccuccggcacauaugggaccggcucuuggccugauggagccgacauuaaccuuaugcccaucuga

SEQ ID NO: 198910 - RNA, 1413 nt, Artificial Sequence; identical to SEQ ID NO: 197852
  derived and/or modified sequence opt5 from neuraminidase__InfluenzaA__ABU80301

SEQ ID NO: 198911 - RNA, 1413 nt, Artificial Sequence
  derived and/or modified sequence opt5 from neuraminidase__InfluenzaA__ABU80312
augaacaccaaucagaagaucauuacaaucggcagcauuuccaucgccauugggaucaucucucugaugcuccaaauuggaaacaucauuagcaucugggcuucccacucuauucagacgggcagccagaaucauaccgggaucugcaaccagagaauuaucacauacgaaaauuccaccugggugaaccacacauaugucaauaucaacaauaccaacguuguggccggaaaagacaagacaucugugacccuggcgggcaauagcucccuuuguagcauuucugggugggcuaucuacacgaaagauaacuccauucggaucggaagcaagggcgacgucuucgugaugcgcgagcccuuuauuucuugcucccaucuggaguguagaaccuucuuucucacacaaggcgcccugcuuaaugauaaacacagcaacgggaccguuaaggaccggucuccuuaucgcgcccugauguccugcccgcucggagaagcucccagcccuuacaauuccaaguucgagucuguggccuggagcgcuuccgccugucaugauggcaugggguggcugacaaucggaaucagcggccccgacaacggggcggucgccgugcugaaauauaacggaauuaucaccgaaacgauuaagucuuggaaaaagagaauccuccggacacaggaguccgagugcguuugugugaauggcagcugcuuuaccauuaugacagauggcccuucuaacggggcugccagcuacaaaaucuucaagaucgaaaagggaaaagucaccaaguccauugagcugaaugcucccaacuuucacuaugaagaguguucuugcuacccugacaccggcacagugaugugugugugccgcgauaauuggcacgggagcaacagaccgugggucuccuucaaucagaaccuugacuaccagaucggauauauuugcagcggcguuuuuggggauaauccccggccuaaagacggagagggcucuuguaaccccgugacgguggauggcgccgacggggucaagggauucuccuacaaauauggcaaugggguguggaucggacgcaccaagagcaacagacugcggaaaggcuuugaaaugauuugggacccuaauggguggacagauaccgacucuaacuucuccguuaagcaagauguggucgcgaucacagacuggagcggcuacuccggaucuuuugugcagcaucccgagcucaccggccuggauugcauucgcccguguuucuggguugaacuugugagagggcugccucgggagaauacgacaaucuggaccagcggauccucuaucagcuucugcggcgucaacuccgacaccgccaacuggagcuggcccgauggggcugaacucccuuuuacaauugacaaguga

SEQ ID NO: 198912 - RNA, 1410 nt, Artificial Sequence; identical to SEQ ID NO: 197754
  derived and/or modified sequence opt5 from neuraminidase__InfluenzaA__ABU80323

SEQ ID NO: 198913 - RNA, 1410 nt, Artificial Sequence
  derived and/or modified sequence opt5 from neuraminidase__InfluenzaA__ABU80334
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagacccuccgcacacaggaaagcgagugcgucuguauuaacggcacgugcaccguggugaugacagacgggucugccuccggaaaagcggauaccaagauccuguuuauugaggaaggcaaaaucauccacauuagcacacuuuccgggucugcccaacacgucgaggaaugcagcuguuauccuagauaccccggaguucggugcgugugucgcgacaacuggaagggcuccaauagaccuaucguggauauuaacgucaaggacuacagcaucgugucuuccuauguuugcagcggccuggugggggacacgccccggaaaaaugauucuuucagcuccucucauugucucgacccgaacaaugaggaaggaggccacggggucaagggaugggcuuuugaugacggcaacgauguguggauggggcgcaccauuagcgagaaacugagauccggauacgagacauucaagguuaucgaaggcuggagcaaaccuaauucuaagcugcagaucaaccgccaggugauugucgagcggggcaauagauccggguauagcggaaucuuuucuguggaaggcaaauccugcauuaaccgguguuucuacgucgagcucaucagagggcgcaaggaagagaccgaggugugguggaccagcaauuccauuguuguguuuugcggaacaucuggcaccuaugggacaggcagcuggcccgacggagccgauaucaaccugaugccuauuuga

SEQ ID NO: 198914 - RNA, 1410 nt, Artificial Sequence; identical to SEQ ID NO: 197178
  derived and/or modified sequence opt5 from neuraminidase__InfluenzaA__ABU92762

SEQ ID NO: 198915 - RNA, 1410 nt, Artificial Sequence
  derived and/or modified sequence opt5 from neuraminidase__InfluenzaA__ABU92764
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauggagagaaauauuaccgaaaucguguaucucacaaacaccacgauugagaaggaaaucuguccuaaacuggccgaguaccggaauuggagcaagccccagugcaacgucaccggguucgcgccuuuuuccaaagacaauucuauucgccuuagcgcuggaggcgauaucugggugacaagagagcccuauguuuccugugacccugauaagugcuaccaauucgcccuggggcagggaaccacacucaacaauggccauucuaacgacaccgugcacgaucggacgccguaucgcacacugcugaugaaugaacucgggguccccuuucaucugggaaccagacagguguguauugccuggagcuccagcucuugccacgacggcaaggcuuggcuucauguuugugugacaggcgaugacgagaacgccaccgcuuccuucaucuacaaugggcggcuggucgauagcaucggaucuugguccaaaaagauucuccgcacccaggaaagcgagugcguguguaucaacggcacaugcacgguggucaugaccgacgggucugccuccggaaaagcggauacaaagauucuguuuaucgaggaaggcaaaauuguucacaucagcacccuuuccgggucugcccaacacguggaggaaugcagcuguuauccuagauaccccggagugcggugcgucugucgcgacaacuggaagggcuccaauagaccuaucguggauauuaacguuaaggacuacagcaucgugucuuccuaugucugcagcggccuggugggggacacaccccggaaaaaugauucuuucagcuccucucauugucucgacccgaacaaugaggaaggaggccacgggguuaagggaugggcuuuugaugacggcaacgauguguggauggggcgcaccauuagcgagaaacugagauccggauacgagacguucaaggucaucgaaggcuggagcaaaccuaauucuaagcugcagauuaaccgccaggugaucgucgagcggggcaauagauccggguauagcggaaucuuuucuguggaaggcaaauccugcauuaaccgguguuucuacguugagcucaucagagggaagaaggaagagacagaggugugguggaccagcaauuccauugucguguuuugcggaaccucuggcacauaugggaccggcagcuggcccgacggagccgauaucaaccugaugccuauuuga

SEQ ID NO: 198916 - RNA, 1410 nt, Artificial Sequence; identical to SEQ ID NO: 197178
  derived and/or modified sequence opt5 from neuraminidase__InfluenzaA__ABU92765

SEQ ID NO: 198917 - RNA, 1410 nt, Artificial Sequence; identical to SEQ ID NO: 197178
  derived and/or modified sequence opt5 from neuraminidase__InfluenzaA__ABU92766

SEQ ID NO: 198918 - RNA, 1410 nt, Artificial Sequence; identical to SEQ ID NO: 197178
  derived and/or modified sequence opt5 from neuraminidase__InfluenzaA__ABU92767

SEQ ID NO: 198919 - RNA, 1410 nt, Artificial Sequence; identical to SEQ ID NO: 197178
  derived and/or modified sequence opt5 from neuraminidase__InfluenzaA__ABU92768

SEQ ID NO: 198920 - RNA, 1410 nt, Artificial Sequence; identical to SEQ ID NO: 197085
  derived and/or modified sequence opt5 from neuraminidase__InfluenzaA__ABU92769

SEQ ID NO: 198921 - RNA, 1410 nt, Artificial Sequence; identical to SEQ ID NO: 197277
  derived and/or modified sequence opt5 from neuraminidase__InfluenzaA__ABU92770

SEQ ID NO: 198922 - RNA, 1410 nt, Artificial Sequence
  derived and/or modified sequence opt5 from neuraminidase__InfluenzaA__ABU92771
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccuaacaagugcuaccaauucgcccuggggcagggaaccacacucaauaacggccauucuaaugauaccguucacgaccggacgccguaucgcacacugcugaugaacgaacucggggugcccuuucaucugggaaccaagcaggucuguaucgccuggagcuccagcucuugccacgauggcaaagccuggcuucauguguguguuacaggcgacgaugagaaugcuaccgcuuccuucauuuacaacgggagacugguggacagcaucggaucuugguccaagaaaauucuccggacccaggaaagcgagugcgucuguaucaacggcacaugcacgguggugaugaccgaugggucugccuccggaaaggcggacacaaaaauucuguuuaucgaggaaggcaagaucguccacaccagccuucuguccgggucugcccaacacguugaggaaugcagcuguuauccucgcuaccccggagugagaugcgugugucgggauaauuggaagggcuccaaccgcccuauugucgacaucaaugugaaagauuacagcauuguuucuuccuaugugugcagcggccucgucggggacacacccagaaagaacgacucuagcuccucuagccauugucuggauccgaauaacgaggaaggaggccacggggugaaaggaugggcuuucgacgauggcaaugacguuuggauggggcggaccaucuccgagaagcugcgcagcggauacgagacguuuaaagugauugaaggcuggucuaagccuaacuccaaacuccagaucaauagacaggucaucguggaucggggcaaccgcagcggguauucuggaauuuucuccgucgagggcaagagcugcaucaauagauguuuuuacguggaacugauucgggggagaaagcaggagacagaaguucuuuggaccuccaacucuaucguggucuucugcggaaccagcggcacauaugggaccggcuccuggcccgacggagccgauauuaaucugaugccuaucuga

SEQ ID NO: 198923 - RNA, 1410 nt, Artificial Sequence
  derived and/or modified sequence opt5 from neuraminidase__InfluenzaA__ABU92772
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaacauucuccgcacccaggaaagcgagugcgucuguaucaacggcacaugcacgguggugaugaccgacgggucugccuccggaaaggcggauacaaaaauucuguuuaucgaggaaggcaagaucguccacauuagcacccuuuccgggucugcccaacacguugaggaaugcagcuguuauccuagauaccccggagugcggugcgugugucgcgacaauuggaaaggcuccaacagaccuaucgucgauauuaaugugaaggacuacagcaucguuucuuccuaugugugcagcggccuggucggggacacaccccggaagaacgauucuuucagcuccucucauugucucgacccgaauaacgaggaaggaggccacggggugaaaggaugggcuuuugaugacggcaaugauguuuggauggggcgcaccauuagcgagaagcugagauccggauacgagacguucaaagugaucgaaggcuggagcaagccuaacucuaaacugcagaucaaucggcaggucauuguggagcgcggcaacagauccggguauagcggaaucuuuucugucgaaggcaaguccugcauuaaucgguguuucuacguggagcucaucagagggcgcaaagaagagacagagguuugguggaccagcaacuccauuguggucuuuugcggaaccucuggcacauaugggaccggcagcuggcccgacggagccgauaucaaucugaugccuauuuga

SEQ ID NO: 198924 - RNA, 1410 nt, Artificial Sequence
  derived and/or modified sequence opt5 from neuraminidase__InfluenzaA__ABU92773
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaacaguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauauuugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggcuuggcuucauguguguguuaccggcgaugacgagaacgccaccgcuuccuucaucuacaaugggcggcugguggauagcauuggaucuugguccaaaaagauccuccgcacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccaacacguugaggaaugcagcuguuauccuagauaccccggagugcggugcgugugucgcgacaacuggaagggcuccaauagaccuauugucgauaucaacgugaaggacuacagcauuguuucuuccuaugugugcagcggccuggucggggacacgccccggaaaaaugauucuuucagcuccucucauugucucgacccgaacaaugaggaaggaggccacggggugaagggaugggcuuuugaugacggcaacgauguuuggauggggcgcaccaucagcgagaaacugagauccggauacgagacauucaaggugauugaaggcuggagcaaaccuaauucuaagcugcagaccaaccggcaggucaucguggagcgcggcaauagauccggguauagcggaaucuuuucugucgaaggcaaauccugcauuaaccgguguuucuacguggagcucaucagagggcgcaaggaagagaccgagguuugguggacaagcaauuccauuguggucuuuugcggaaccucuggcacauaugggacgggcagcuggcccgacggagccgauaucaaccugaugccuauuuga

SEQ ID NO: 198925 - RNA, 1410 nt, Artificial Sequence
  derived and/or modified sequence opt5 from neuraminidase__InfluenzaA__ABU92774
augaaccccaauagaaagaucauuaccaucggcagcgugucccugacaauugccacgaucugcuuccucaugcagauugcuauccuggucaccacaguuacccuucacuuuaaacaauacgaguguaacucuccuccgaauaaccaggugaugcugugcgaacccacaaucauugagcggaauaucaccgaaacaguguaucucaccaacacgaccauugagaaggaaaucuguccuaaacuggccgaguaccgcaauuggagcaagccccagugcaacauuacaggguucgcgccuuuuuccaaagacaauucuaucagacuuagcgcuggaggcgauauuugggucacccgggagcccuauguguccugugacccugauaagugcuaccaguucgcccuggggcaaggaacaacccucaacaauggccauucuaacgacacgguucacgaucgcacaccguauagaacccugcugaugaaugaacucggggugcccuuucaucugggaacacggcaggucuguaucgccuggagcuccagcucuugccacgacggcaaggcuuggcuucauguguguguuaccggcgaugacgagaacgccaccgcuuccuucaucuacaaugggcgccugguggauagcauuggaucuugguccaaaaagauccucagaacacaggaaagcgagugcgucuguauuaacggcacgugcaccguggugaugacagacgggucugccuccggaaaagcggauaccaagauccuguuuauugaggaaggcaaaaucguccacaucagcacacuuuccgggucugcccagcacguugaggaaugcagcuguuauccucgguaccccggagugcgcugcguguguagagacaacuggaagggcuccaaucggccuauugucgauaucaacgugaaggacuacagcauuguuucuuccuaugugugcagcggccuggucggggacacgccccgcaaaaaugauucuuucagcuccucucauugucucgacccgaacaaugaggaaggaggccacggggugaagggaugggcuuuugaugacggcaacgauguuuggauggggagaaccaucagcgagaaacugcgguccggauacgagacauucaaggugauugaaggcuggagcaaaccuaauucuaagcugcaaaccaaccgccaggucaucguggagagaggcaaucgguccggguauagcggaaucuuuucugucgaaggcaaauccugcauuaacagauguuucuacguggagcucauccgcgggcggaaggaagagaccgagguuugguggacaagcaauuccauuguggucuuuugcggaaccucuggcacauaugggacgggcagcuggcccgacggagccgauaucaaccugaugccuauuuga

SEQ ID NO: 198926 - RNA, 1410 nt, Artificial Sequence
  derived and/or modified sequence opt5 from neuraminidase__InfluenzaA__ABU92775
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacaaaaacgccaccgcuuccuucauuuacaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacacguugaagagugcagcuguuauccuagauaccccggagugcggugcgugugucgcgacaacuggaagggcuccaauagaccuaucgucgauauuaacgugaaagacuacagcaucguuucuuccuaugugugcagcggccuggucggggacacaccccggaagaaugauucuuucagcuccucucauugucucgacccgaacaaugaagagggaggccacggggugaaaggaugggcuuuugaugacggcaacgauguuuggauggggcgcaccauuagcgaaaagcugagauccggauacgagacguucaaagugaucgagggcuggagcaagccuaauucuaaacugcagaucaaccggcaggucauuguggaacgcggcaauagauccggguauagcggaaucuuuucugucgagggcaaguccugcauuaaccgguguuucuacguggaacucaucagagggcgcaaggaggaaacagagguuugguggaccagcaauuccauuguggucuuuugcggaaccucuggcacauaugggaccggcagcuggcccgacggagccgauaucaaccugaugccuauuuga

SEQ ID NO: 198927 - RNA, 1410 nt, Artificial Sequence; identical to SEQ ID NO: 197351
  derived and/or modified sequence opt5 from neuraminidase__InfluenzaA__ABU92777

SEQ ID NO: 198928 - RNA, 1410 nt, Artificial Sequence
  derived and/or modified sequence opt5 from neuraminidase__InfluenzaA__ABU92778
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacucgcugaguaccggaauugguccaagccccaguguaacaucaccggguucgccccuuuuucuaaagacaauagcauucgccuguccgcgggaggcgauaucugggucacaagagagcccuaugugucuugcgacccugauaaguguuaccaauucgcucuugggcagggaaccacacugaacaauguucauagcaacgacaccgugcacgaucggacgccguaucgcacacuccugaugaaugaacugggcguccccuuucaucucgggaccaaacaggugugcaucgccugguccucuagcuccugucacgacggaaaggccuggcugcauguuugcgugacaggcgaugacaagaacgcuaccgccagcuucauuuacaauggcagacuugucgauucuaucguguccuggagcaaagagauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgauguguggaugggacggacgauuagcgagaagcuccgcucuggcuacgagacauuuaaagucaucgaagggugguccaauccuaacagcaagcugcagaucaauagacaggugauugucgaccggggaaaccgcucuggcuauuccggcaucuucagcguggaggggaaauccuguauuaauagaugcuuuuacguugaacugauccggggaagaaaggaggaaaccgaggugcucuggaccucuaacagcauugucguguucuguggcacauccgggaccuauggaacaggcucuuggcccgauggggcugacaucaaucugaugccuauuuga

SEQ ID NO: 198929 - RNA, 1410 nt, Artificial Sequence; identical to SEQ ID NO: 197249
  derived and/or modified sequence opt5 from neuraminidase__InfluenzaA__ABU92779

SEQ ID NO: 198930 - RNA, 1410 nt, Artificial Sequence; identical to SEQ ID NO: 197249
  derived and/or modified sequence opt5 from neuraminidase__InfluenzaA__ABU92780

SEQ ID NO: 198931 - RNA, 1410 nt, Artificial Sequence; identical to SEQ ID NO: 197249
  derived and/or modified sequence opt5 from neuraminidase__InfluenzaA__ABU92781

SEQ ID NO: 198932 - RNA, 1410 nt, Artificial Sequence
  derived and/or modified sequence opt5 from neuraminidase__InfluenzaA__ABU92782
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgccgggaggaaacggagguuugguggacaagcaauuccauuguggucuuuugcggaaccucuggcaccuacgggacaggcagcuggcccgacggagcugauaucaaccugaugccuauuuga

SEQ ID NO: 198933 - RNA, 1410 nt, Artificial Sequence; identical to SEQ ID NO: 197249
  derived and/or modified sequence opt5 from neuraminidase__InfluenzaA__ABU92783

SEQ ID NO: 198934 - RNA, 1410 nt, Artificial Sequence; identical to SEQ ID NO: 197249
  derived and/or modified sequence opt5 from neuraminidase__InfluenzaA__ABU92784

SEQ ID NO: 198935 - RNA, 1410 nt, Artificial Sequence; identical to SEQ ID NO: 197249
  derived and/or modified sequence opt5 from neuraminidase__InfluenzaA__ABU92785

SEQ ID NO: 198936 - RNA, 1410 nt, Artificial Sequence; identical to SEQ ID NO: 197249
  derived and/or modified sequence opt5 from neuraminidase__InfluenzaA__ABU92786

SEQ ID NO: 198937 - RNA, 1410 nt, Artificial Sequence
  derived and/or modified sequence opt5 from neuraminidase__InfluenzaA__ABU92787
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagacaccccggagugcggugcgugugucgcgacaacuggaagggcuccaauagaccuaucgucgauauuaacgugaaagacuauagcaucguuucuuccuacgugugcagcggccuggucggggacacaccccggaagaaugauucuuucagcuccucucauugucucgacccgaacaaugaagagggaggccacggggugaaaggaugggccuuugaugacggcaacgauguuuggauggggcgcaccauuagcgaaaagcugagauccggauacgagaccuucaaagugaucgagggcuggagcaagccuaauucuaaacugcagaucaaccggcaggucauuguggaacgcggcaauagauccggguauagcggaaucuuuucugucgagggcaaguccugcauuaaccgguguuucuacguggaacucaucagagggcgcaaggaggaaacggagguuugguggacaagcaauuccauuguggucuuuugcggaaccucuggcaccuaugggacaggcagcuggcccgacggagcugauaucaaccugaugccuauuuga

SEQ ID NO: 198938 - RNA, 1410 nt, Artificial Sequence
  derived and/or modified sequence opt5 from neuraminidase__InfluenzaA__ABU92789
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucaguguuccauuaccggguucgcccccuuuucuaaagacaacagcauccgccuguccgcgggaggcgauaucugggugacaagagagccuuaugucucuugcgacccggauaaguguuaccaauucgcucuugggcagggaaccacacugaauaacgugcauagcaaugacaccguucacgaucggacgcccuaucgcacacuccugaugaacgaacugggcgugccuuuucaucucgggaccaagcaggucugcauugccugguccucuagcuccugucacgacggaaaagccuggcugcaugugugcguuacaggcgaugacaagaaugcuaccgccagcuucaucuacaacggcagacuuguggauucuauugucuccuggagcaaagagauccugcggacccaggaaucugagugugugugcauuaaugggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccccgcuacccuggcgugagaugugucugccgggacaacuggaaggggagcaaccgccccaucguggauauuaauaucaaagacuacucuauuguuuccagcuauguguguucuggacuugucggcgacaccccgagaaagaacgauagcuccucuagcucccauugccuggacccuaauaacgaggaaggcgggcacggagugaaaggcugggccuucgaugacgggaaugauguuuggaugggacggacgaucagcgagaagucucgcuccggcuacgagacauuuaaagugaucgaaggguggagcaaccccaauucuaagcuccagauuaacagacaggucaucguggaccggggaaaucgcuccggcuauagcggcauuuucuccgucgaggggaaaucuuguaucaacagaugcuuuuacguggaacugauucggggaagaaaggaggaaaccgagguucuguggaccagcaauuccaucguggucuucuguggcacaucugggaccuauggaacaggcagcuggccugauggggcugacauuaaccucaugcccaucuga

SEQ ID NO: 198939 - RNA, 1410 nt, Artificial Sequence; identical to SEQ ID NO: 197351
  derived and/or modified sequence opt5 from neuraminidase__InfluenzaA__ABU92790

SEQ ID NO: 198940 - RNA, 1410 nt, Artificial Sequence
  derived and/or modified sequence opt5 from neuraminidase__InfluenzaA__ABU92791
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuaccguuuccagcuauguguguucuggacuugucggcgauacgccccggaaaaacgacagcuccucuagcucccauugccuggauccgaauaacgaagagggcgggcacggagugaagggcugggccuucgacgaugggaaugacguuuggaugggaagaacaauuagcgaaaaacuccgcucuggcuacgagaccuuuaaggugaucgaggggugguccaacccuaauagcaaacugcagaucaacagacaggucauuguggaucggggaaaucgcucuggcuauuccggcaucuucagcgucgaagggaaguccuguauuaacagaugcuuuuacguggagcugauccggggaagaaaggaagagaccgaaguucucuggacaucuaauagcauuguggucuucuguggcaccuccgggacauauggaacgggcucuuggcccgacggggcugauaucaaccugaugccuauuuga

SEQ ID NO: 198941 - RNA, 1410 nt, Artificial Sequence
  derived and/or modified sequence opt5 from neuraminidase__InfluenzaA__ABU92792
augaaccccaaucagaagaucauuaccaucggcagcgugucccugacaauuucuacgaucugcuucuuuaugcaaauugccauccucaucaccacagucacccugcacuucaaacaguacguuuuuaacagcccuccgaauaaccaggugaugcuuugugagcccacaauuaucgaaagaaauauuaccgagaucguguaucugacaaacaccacgauugaaaaggagaucugcccuaaacucgcugaauaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaaugauaccgugcacgaccggacgccguaucgcacacuccugaugaacgagcugggcguccccuuucaucucgggaccaaacaggugugcauugccugguccucuagcuccugucacgauggaaaggccuggcugcauguuugcgugacaggcgacgauaagaaugcuaccgccagcuucaucuacaacggcagacuugucgacucugugguguccuggagcaaagauauucugcggacccaggaaucugagugugucugcaucaaugggacauguacgguugugaugaccgacggauccgcuagcggcaaggccgauacaaaaauucucuuuaucgaagaggggaagaucgugcacaccuccacacugucuggaagcgcgcaacacgucgaggaaugcuccugcuauccucgcuaccccggcgugagauguguuugccgggacaacuggaaggggagcaaccgcccuauuguggacaucaauauuaaaaacuacucuaucgucuccagcuauguguguucuggacuuguuggcgauacccccagaaagacggacagcuccucuagcucccauugccuggauccgaauaacgaggaaggcgggcacggagugaaaggcugggccuucgacgaugggaaugacgucuggaugggacggacaauuagcgagaagcuccgccugggcuacgaaaccuuuaaagugaucgagggguggucuaacccuaauuccaagcugcagaucaacagacaggucauuguggaucggggaaaucgcagcggcuauucuggcaucuucuccguugaggggaaaagcuguauuaacagaugcuuuuacguggaacucauccggggaagaaaggaggaaaccgagguccuguggacauccaauucuauugugguuuucuguggcaccagcgggacauauggaacgggcuccuggcccgacggggcugauaucaaccuuaugccuauuuga

SEQ ID NO: 198942 - RNA, 1410 nt, Artificial Sequence; identical to SEQ ID NO: 197831
  derived and/or modified sequence opt5 from neuraminidase__InfluenzaA__ABU92793

SEQ ID NO: 198943 - RNA, 1410 nt, Artificial Sequence; identical to SEQ ID NO: 198938
  derived and/or modified sequence opt5 from neuraminidase__InfluenzaA__ABU92794

SEQ ID NO: 198944 - RNA, 1410 nt, Artificial Sequence; identical to SEQ ID NO: 197249
  derived and/or modified sequence opt5 from neuraminidase__InfluenzaA__ABU92795

SEQ ID NO: 198945 - RNA, 1410 nt, Artificial Sequence; identical to SEQ ID NO: 197249
  derived and/or modified sequence opt5 from neuraminidase__InfluenzaA__ABU92796

SEQ ID NO: 198946 - RNA, 1410 nt, Artificial Sequence
  derived and/or modified sequence opt5 from neuraminidase__InfluenzaA__ABU92797
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagcgcauucucagaacccaggagagcgaaugcgucuguaucaacgggaccugcacaguggugaugacggacggcucugcguccggaaaagccgauaccaagauucuguuuaucgaggagggcaaaaucguccacauuagcacacuuuccgggucugcucaacauguugaagagugcagcuguuacccucgguaucccggagugcgcugcguguguagagacaacuggaagggcuccaaucggccuaucgucgauauuaacgugaaggacuacagcaucguuucuuccuacgugugcagcggccuggucggggacacaccccgcaaaaaugauucuuucagcuccucucacugucucgacccgaacaaugaagagggaggccauggggugaagggaugggccuuugaugacggcaacgauguuuggauggggagaaccauuaaugaaaaacugcggagcggauaugagaccuucaaggugaucgagggcugguccaaaccuaacagcaagcugcagaucaaucgccaggucauuguggaaagaggcaaccggucuggguacuccggaaucuuuagcgucgagggcaaaucuugcauuaauagauguuucuauguggaacucauccgcgggcggaaggaggaaacggagguuugguggacauccaacagcauuguggucuuuugcggaaccuccggcaccuacgggacaggcucuuggcccgacggagcugauaucaaucugaugccuauuuga

SEQ ID NO: 198947 - RNA, 1410 nt, Artificial Sequence; identical to SEQ ID NO: 197249
  derived and/or modified sequence opt5 from neuraminidase__InfluenzaA__ABU92798

SEQ ID NO: 198948 - RNA, 1410 nt, Artificial Sequence; identical to SEQ ID NO: 197249
  derived and/or modified sequence opt5 from neuraminidase__InfluenzaA__ABU92799

SEQ ID NO: 198949 - RNA, 1410 nt, Artificial Sequence; identical to SEQ ID NO: 197249
  derived and/or modified sequence opt5 from neuraminidase__InfluenzaA__ABU92800

SEQ ID NO: 198950 - RNA, 1410 nt, Artificial Sequence
  derived and/or modified sequence opt5 from neuraminidase__InfluenzaA__ABU92801
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauugugcaccucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagagcccuauguguccugugacccugauaagugcuaccaauucgcccuggggcagggaacaacccucaacaauggccauucuaacgacacaguucacgaucggaccccguaucgcacgcugcugaugaaugaacucggggugcccuuucaucugggaacaagacaggucuguaucgcuuggagcuccagcucuugccacgacggcaaggccuggcuucacguguguguuaccggcgaugacaaaaacgcuacagccuccuucauuuacaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccauauuagcacacuuuccgggucugcucaacacguugaagagugcagcuguuauccuagauaccccggagugcggugcgugugucgcgacaacuggaagggcuccaauagaccuaucgucgauauuaacgugaaagacuauagcaucguuucuuccuacgugugcagcggccuggucggggacacaccccggaagaaugauucuuucagcuccucucauugucucgacccgaacaaugaagagggaggccacggggugaaaggaugggccuuugaugacggcaacgauguuuggauggggcgcaccauuagcgaaaagcugagauccggauacgagaccuucaaagugaucgagggcuggagcaagccuaauucuaaacugcagaucaaccggcaggucauuguggaacgcggcaauagauccggguauagcggaaucuuuucugucgagggcaaguccugcauuaaccgguguuucuacguggaacucaucagagggcgcaaggaggaaacggagguuugguggacaagcaauuccauuguggucuuuugcggaaccucuggcaccuaugggacaggcagcuggcccgacggagcugauaucaaccugaugccuauuuga

SEQ ID NO: 198951 - RNA, 1410 nt, Artificial Sequence; identical to SEQ ID NO: 197249
  derived and/or modified sequence opt5 from neuraminidase__InfluenzaA__ABU92802

SEQ ID NO: 198952 - RNA, 1410 nt, Artificial Sequence; identical to SEQ ID NO: 197249
  derived and/or modified sequence opt5 from neuraminidase__InfluenzaA__ABU92804

SEQ ID NO: 198953 - RNA, 1410 nt, Artificial Sequence
  derived and/or modified sequence opt5 from neuraminidase__InfluenzaA__ABU92805
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaagcaggagaccgaaguucucuggaccucuaacagcaucguggucuucuguggcacauccgggaccuauggaacaggcucuuggcccgauggggcugacauuaaucugaugccuaucuga

SEQ ID NO: 198954 - RNA, 1410 nt, Artificial Sequence; identical to SEQ ID NO: 198953
  derived and/or modified sequence opt5 from neuraminidase__InfluenzaA__ABU92806

SEQ ID NO: 198955 - RNA, 1410 nt, Artificial Sequence
  derived and/or modified sequence opt5 from neuraminidase__InfluenzaA__ABU92808
augaaccccaaucagaagaucauuaccaucggcagcgugucccugacaauugccacgaucugcuuccucaugcaaauuaccauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggcugaguaccggaauuggagcaagccccagugcaacaucacaggguucgccccuuuuuccaaagacaauucuauucgccuuagcgcgggaggcgauaucugggucaccagagagcccuauguguccugugacccugauaagugcuaccaauucgcucuggggcagggaacaacccucaacaauggccauucuaacgacacgguucacgaucggacaccguaucgcacccugcugaugaaugaacucggggugcccuuucaucugggaacaagacaggucuguaucgccuggagcuccagcucuugccacgacggcaaggccuggcuucauguguguguuaccggcgaugacaaaaacgcuaccgccuccuucauuuacaaugggcggcugguggauagcaucggaucuugguccaagaaaauucuccgcacacaggagagcgaaugcgucuguaucaacggcacgugcaccguggugaugacagacgggucugcuuccggaaaggccgauaccaaaauucuguuuaucgaggagggcaagaucauucacaucagcacacuuuccgggucugcgcaacacgucgaagagugcagcuguuauccuagauaccccggaguucggugcgugugucgcgacaacuggaagggcuccaauagaccuauuguggauaucaacgucaaagacuacagcauugugucuuccuauguuugcagcggccuggugggggacacgccccggaagaaugauucuagcuccucuagccauugucucgacccgaacaaugaagagggaggccacggggucaaaggaugggccuucgaugacggcaacgauguguggauggggcgcaccaucuccgaaaagcugagaagcggauacgagacauuuaaaguuaucgagggcuggucuaagccuaauuccaaacugcagauuaaccgccaggugaucgucgaacggggcaauagaagcggguauucuggaauuuucuccguggagggcaagagcugcaucaaccgguguuuuuacgucgaacucauuagagggcgcaaggaggaaaccgaggugugguggaccuccaauucuaucguuguguucugcggaacaagcggcaccuaugggacaggcuccuggcccgacggagcugauauuaaccugaugccuaucuga

SEQ ID NO: 198956 - RNA, 1410 nt, Artificial Sequence
  derived and/or modified sequence opt5 from neuraminidase__InfluenzaA__ABU92809
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcggccauugccuggacccgaacaaugaggaagggggacacggcgugaaagggugggccuucgaugacggaaacgauguuuggaugggccggacgaucuccgagaagcuccgcagcggguacgagacauuuaaagugaucgaaggauggucuaauccuaacuccaagcugcagauuaauagacaggucaucguggaccggggcaaccgcagcggcuauucugggauuuucuccgucgagggaaaaagcuguaucaauagaugcuuuuacguggaacugauucggggcagaaaggaggaaaccgauguucucuggaccuccaacucuaucguggucuucugugggacaagcggaaccuauggcacaggguccuggcccgacggcgcugauauuaaucugaugccuaucuga

SEQ ID NO: 198957 - RNA, 1410 nt, Artificial Sequence
  derived and/or modified sequence opt5 from neuraminidase__InfluenzaA__ABU92810
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaaggcgggaaucgcuccggauacagcggcaucuuuucugucgaggggaaguccugcauuaacagauguuucuauguggaacucauccggggaagaaaggaggaaacggagguuugguggacaagcaauuccauuguggucuuuugcggcaccucugggaccuacggcacaggaagcuggcccgacggcgcugauaucaaccugaugccuauuuga

SEQ ID NO: 198958 - RNA, 1410 nt, Artificial Sequence
  derived and/or modified sequence opt5 from neuraminidase__InfluenzaA__ABU92811
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaugaucgagagaaauauuacagaaaucguguaccucaccaacacaaccauugagaaggaaaucuguccuaaacuggcggaguaucggaauuggagcaagccccagugcaacauuacgggguucgcuccuuuuuccaaagacaauucuauccgccuuagcgccgucggagauauuugggugaccagagagcccuacguuuccugugacccugauaagugcuaucaauucgcccugggccaggggacaacccucaacaauggacacucuaacgacacagugcaugaucggaccccguaccgcacgcugcugaugaaugaacucggcguccccuuucaccuggggacaagacagguguguaucgcuuggagcuccagcucuugccaugacggaaaggccuggcuucacguuugugugaccggcgaugacaaaaacgcuacagccuccuucaucuauaauggccggcuggucgauagcauugggucuugguccaagaaaauccuccgcacccaggagagcgaaugcguguguauuaacggaaccugcacaguggucaugacggacggcucugcguccgggaaggccgauaccaaaauccuguuuauugaggagggaaagaucguucacaucagcacacuuuccggcucugcucaacauguggaagagugcagcuguuacccuagauaucccggggugcggugcgucugucgcgacaacuggaagggauccaauagaccuauuguggauaucaacguuaaagacuacagcauugugucuuccuacgucugcagcggccuggugggcgacacaccccggaagaaugauucuuucagcuccucucacugucucgacccgaacaaugaagaagggggacauggcguuaaagggugggccuuugaugacggaaacgauguguggaugggccgcaccaucagcgagaagcugagauccggguaugagaccuucaaagucauugagggauggagcaagccuaauucuaaacugcagaucaaccgccaggugaucgucgaacggggcaauagauccggcuacagcgggaucuuuucuguggagggaaaguccugcauuaaccgguguuucuauguugaacucauuagaggccgcaaggaggaaacggaggugugguggacaagcaauuccaucgucguguuuugcgggaccucuggaaccuacggcacagggagcuggcccgacggcgcugauauuaaccugaugccuaucuga

SEQ ID NO: 198959 - RNA, 1410 nt, Artificial Sequence; identical to SEQ ID NO: 197249
  derived and/or modified sequence opt5 from neuraminidase__InfluenzaA__ABU92814

SEQ ID NO: 198960 - RNA, 1410 nt, Artificial Sequence; identical to SEQ ID NO: 197738
  derived and/or modified sequence opt5 from neuraminidase__InfluenzaA__ABU92815

SEQ ID NO: 198961 - RNA, 1410 nt, Artificial Sequence; identical to SEQ ID NO: 197249
  derived and/or modified sequence opt5 from neuraminidase__InfluenzaA__ABU92816

SEQ ID NO: 198962 - RNA, 1410 nt, Artificial Sequence
  derived and/or modified sequence opt5 from neuraminidase__InfluenzaA__ABU92817
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgaguccaagagcugcauuaaccgguguuucuauguggaacucaucagaggccgcaaggaggaaacggagguuugguggacauccaauucuauuguggucuuuugcgggaccagcggaaccuacggcacaggguccuggcccgacggcgcugauaucaaccugaugccuauuuga

SEQ ID NO: 198963 - RNA, 1410 nt, Artificial Sequence; identical to SEQ ID NO: 197249
  derived and/or modified sequence opt5 from neuraminidase__InfluenzaA__ABU92818

SEQ ID NO: 198964 - RNA, 1410 nt, Artificial Sequence; identical to SEQ ID NO: 197249
  derived and/or modified sequence opt5 from neuraminidase__InfluenzaA__ABU92819

SEQ ID NO: 198965 - RNA, 1410 nt, Artificial Sequence; identical to SEQ ID NO: 197249
  derived and/or modified sequence opt5 from neuraminidase__InfluenzaA__ABU92821

SEQ ID NO: 198966 - RNA, 1410 nt, Artificial Sequence; identical to SEQ ID NO: 197249
  derived and/or modified sequence opt5 from neuraminidase__InfluenzaA__ABU92822

SEQ ID NO: 198967 - RNA, 1410 nt, Artificial Sequence; identical to SEQ ID NO: 197161
  derived and/or modified sequence opt5 from neuraminidase__InfluenzaA__ABU92823

SEQ ID NO: 198968 - RNA, 1410 nt, Artificial Sequence
  derived and/or modified sequence opt5 from neuraminidase__InfluenzaA__ABU92824
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggcgcaaugauucuuucagcuccucucacugucucgacccgaacaaugaagagggaggccauggggugaagggaugggccuuugaugacggcaacgauguuuggauggggagaaccauuagcgaaaaacugcgguccggauaugagaccuucaaggugaucgagggcuggagcaaaccuaauucuaagcugcagaucaaccgccaggucauuguggaaagaggcaaucgguccggguacagcggaaucuuuucugucgagggcaaauccugcauuaacagauguuucuauguggaacucauccgcgggcggaaggaggaaacggagguuugguggacaagcaauuccauuguggucuuuugcggaaccucuggcaccuacgggacaggcagcuggcccgacggagcugauaucaaccugaugccuauuuga

SEQ ID NO: 198969 - RNA, 1410 nt, Artificial Sequence
  derived and/or modified sequence opt5 from neuraminidase__InfluenzaA__ABU92825
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccuaauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaaaagauccugcggacccaggagucugaaugugugugcauuaacgggacauguacgguggucaugaccgacggauccgcuagcggcaaagccgauacaaagauccucuuuaucgaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaaucucgcuccggcuacgagacauuuaaggugaucgagggguggagcaauccuaacucuaaacuccagauuaauagacaggucaucguggaccggggaaaccgcuccggcuauagcggcauuuucuccgucgaagggaagucuuguaucaauagaugcuuuuacguggagcugauucggggaagaaaggaagagaccgaaguucuguggaccagcaacuccaucguggucuucuguggcacaucugggaccuauggaacaggcagcuggcccgauggggcugacauuaaucucaugccuaucuga

SEQ ID NO: 198970 - RNA, 1410 nt, Artificial Sequence; identical to SEQ ID NO: 198969
  derived and/or modified sequence opt5 from neuraminidase__InfluenzaA__ABU92826

SEQ ID NO: 198971 - RNA, 1410 nt, Artificial Sequence; identical to SEQ ID NO: 197249
  derived and/or modified sequence opt5 from neuraminidase__InfluenzaA__ABU92827

SEQ ID NO: 198972 - RNA, 1410 nt, Artificial Sequence; identical to SEQ ID NO: 197249
  derived and/or modified sequence opt5 from neuraminidase__InfluenzaA__ABU92828

SEQ ID NO: 198973 - RNA, 1410 nt, Artificial Sequence; identical to SEQ ID NO: 197738
  derived and/or modified sequence opt5 from neuraminidase__InfluenzaA__ABU92829

SEQ ID NO: 198974 - RNA, 1410 nt, Artificial Sequence
  derived and/or modified sequence opt5 from neuraminidase__InfluenzaA__ABU92830
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucgcugucucgacccgaacaaugaagagggaggccacggggugaaaggaugggccuuugaugacggcaacgauguuuggauggggagaaccauuagcgaaaagcugcgguccggauaugagaccuucaaagugaucgagggcuggagcaagccuaauucuaaacugcagaucaaccgccaggucauuguggaaagaggcaaucgguccggguacagcggaaucuuuucugucgagggcaaguccugcauuaacagauguuucuauguggaacucauccgcgggcggaaggaggaaacggagguuugguggacaagcaauuccauuguggucuuuugcggaaccucuggcaccuacgggacaggcagcuggcccgacggagcugauaucaaccugaugccuauuuga

SEQ ID NO: 198975 - RNA, 1410 nt, Artificial Sequence; identical to SEQ ID NO: 197249
  derived and/or modified sequence opt5 from neuraminidase__InfluenzaA__ABU92831

SEQ ID NO: 198976 - RNA, 1410 nt, Artificial Sequence; identical to SEQ ID NO: 197249
  derived and/or modified sequence opt5 from neuraminidase__InfluenzaA__ABU92832

SEQ ID NO: 198977 - RNA, 1410 nt, Artificial Sequence; identical to SEQ ID NO: 197249
  derived and/or modified sequence opt5 from neuraminidase__InfluenzaA__ABU92833

SEQ ID NO: 198978 - RNA, 1410 nt, Artificial Sequence
  derived and/or modified sequence opt5 from neuraminidase__InfluenzaA__ABU92834
augaaccccaaucagaagaucauuaccaucggcagcgugucccugacaauugccgcuaucugcuuccucaugcacauugccauccuggucacgaccguuacacuucauuuuaaacaacacgaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaguucgcccuggggcaaggaacaacccucaacaauggccauucuaacgacacaguucacgaucggaccccguaccgcacgcugcugaugaaugaacucggggugcccuuucaucugggaacaagacaggucuguaucgcuuggagcuccagcucuugccacgacggcaaggccuggcuucacguguguguuaccggcgaugacgagaacgcuacagccuccuucauuuauaaugggcggcugguggauagcaucggaucuugguccaaaaagauucuccgcacccaggaaagcgagugcgucuguaucaacgggaccugcacaguggugaugacggacggcucugcguccggaaaagccgauaccaagauucuguuuaucgaggaaggcaaaaucguccauauuagcacacuuuccgggucugcucagcacguugaggaaugcagcuguuacccuagauaucccggagugcggugcgugugucgcgacaacuggaagggcuccaauagaccuaucgucgauauuaacgugaaggacuacagcaucguuucuuccuacgugugcagcggccuggucggggacacaccccggaaaaaugauucuuucagcuccucucauugucucgacccgaacaaugaggaaggaggccacggggugaagggaugggccuuugaugacggcaacgauguuuggauggggcgcaccauuagcgagaaacugagauccggauaugagaccuucaaggugaucgaaggcuggagcaaaccuaauucuaagcugcaaaucaaccggcaggucauuguggagcgcggcaauagauccggguacagcggaaucuuuucugucgaaggcaaauccugcauuaaccgguguuucuauguggagcucaucagagggcgcaaggaagagacggagguuugguggacaagcaauuccauuguggucuuuugcggaaccucuggcaccuacgggacaggcagcuggcccgacggagcugauaucucccugaugccuauuuga

SEQ ID NO: 198979 - RNA, 1410 nt, Artificial Sequence; identical to SEQ ID NO: 197249
  derived and/or modified sequence opt5 from neuraminidase__InfluenzaA__ABU92835

SEQ ID NO: 198980 - RNA, 1410 nt, Artificial Sequence; identical to SEQ ID NO: 197249
  derived and/or modified sequence opt5 from neuraminidase__InfluenzaA__ABU92836

SEQ ID NO: 198981 - RNA, 1410 nt, Artificial Sequence
  derived and/or modified sequence opt5 from neuraminidase__InfluenzaA__ABU92837
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaaaagauccugcggacccaggagucugaaugugugugcauuaaugggacauguacgguggucaugaccgauggauccgcuagcggcaaagccgacacaaagauccucuuuaucgaggaggggaagauuguucacaccuccacacugucuggaagcgcgcaacacguggaagagugcuccugcuauccucgcuaccccggcgugagaugugucugccgggauaacuggaaagggagcaaccgcccuaucguggacauuaauaucaaggacuacucuauugccuccagcuauguuuguucuggacuugugggcgauacccccagaaagaacgacagcuccucuagcucccauugccuggauccgaauaacgaagagggcgggcacggagucaaaggcugggcuuucgacgaugggaaugacguguggaugggacggacgaucagcgaaaaacuccgcucuggcuacgagacauuuaagguuaucgaggggugguccaacccuaauagcaaacugcagauuaacagacaggugaucgucgaucggggaaaucgcucuggcuauuccggcauuuucagcguggaagggaaguccugugucaacagaugcuuuuacguggagcugauccggggaagaaaggaagagaccgaaguucucuggaccucuaauagcauuguggucuucuguggcacauccgggaccuauggaacaggcucuuggcccgacggggccgauaucaaccugaugccuauuuga

SEQ ID NO: 198982 - RNA, 1410 nt, Artificial Sequence; identical to SEQ ID NO: 197249
  derived and/or modified sequence opt5 from neuraminidase__InfluenzaA__ABU92838

SEQ ID NO: 198983 - RNA, 1410 nt, Artificial Sequence; identical to SEQ ID NO: 197085
  derived and/or modified sequence opt5 from neuraminidase__InfluenzaA__ABU92839

SEQ ID NO: 198984 - RNA, 1410 nt, Artificial Sequence
  derived and/or modified sequence opt5 from neuraminidase__InfluenzaA__ABU92840
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacauuagccuucuguccgggucugcccaacacguugaggaaugcagcuguuauccucgcuaccccggagugagaugcgugugucgggacaacuggaagggcuccaaucgcccuaucgucgauauuaacgugaaagacuacagcaucguuucuuccuaugugugcagcggccucgucggggacacccccagaaagaaugauucuagcuccucuagccauugucuggacccgaacaaugaggaaggaggccacggggugaaaggaugggcuuucgaugacggcaacgauguuuggauggggcggacaauuuccgagaagcugcgcagcggauacgagaccuuuaaagugaucgaaggcuggucuaagccuaauuccaaacuccagaucaacagacaggucauuguggaccgggauaaucgcagcggcuauucugggaucuucuccgucgagggaaagagcugcauuaacagauguuuuuacguggaacugauccggggcagaaagcaggagacggaaguucuuuggacauccaauucuauuguggucuucugcgggaccagcggaaccuauggcacaggguccuggcccgacggcgccgauaucaaccugaugccuauuuga

SEQ ID NO: 198985 - RNA, 1410 nt, Artificial Sequence
  derived and/or modified sequence opt5 from neuraminidase__InfluenzaA__ABU92841
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacacccagaaagaaugauucuagcuccucuagccauugucuggacccgaacaaugaggaaggaggccacggggugaaaggaugggcuuucgaugacggcaacgauguuuggauggggcggaccaucuccgagaagcugcgcagcggauacgagacguuuaaagugauugaaggcuggucuaagccuaauuccaaacuccagaucaacagacaggucaucguggaccgggauaaucgcagcggcuauucugggauuuucuccgucgagggaaagagcugcaucaacagauguuuuuacguggaacugauucggggcagaaagcaggagacagaaguucuuuggaccuccaauucuaucguggucuucugcgggaccagcggaacauauggcaccggguccuggcccgacggcgccgauauuaaccugaugccuaucuga

SEQ ID NO: 198986 - RNA, 1410 nt, Artificial Sequence
  derived and/or modified sequence opt5 from neuraminidase__InfluenzaA__ABU92842
augaaccccaaucagaagaucauuaccaucggcagcgugucccugacaauugccacgaucugcuuccucaugcaaauugcuauccuggucaccacaguuacccuucacuuuaaacaguacgacuguaacucuccuccgaauaaccaggugaugcugugcgagcccacaaucauugaaagaaauaucaccgagauuguguaucucacaaacaccacgaucgaaaaggagauuuguccuaaacuggccgaauaccggaauuggagcaagccccagugcaacaucaccggguucgcgccuuuuuccaaagauaauucuauucgccuuagcgcuggaggcgacaucugggucacaagagagcccuauguguccugugauccugacaagugcuaccaauucgcccuggggcagggaaccacacucaacaauggccauucuaacgauaccguucacgaccggacgccguaucgcacacugcugaugaaugagcucggggugcccuuucaucugggaaccaagcaggucuguaucgccuggagcuccagcucuugccacgauggcaaagccuggcuucauguguguguuacaggcgacgaugaaaacgcuaccgcuuccuucauuuacaaugggagacugguggacagcaucggaucuugguccaagaaaauucuccggacccaggagagcgaaugcgucuguaucaacggcacaugcacgguggugaugaccgaugggucugccuccggaaaggcggacacaaaaauucuguuuaucgaggagggcaagaucguccacaccagccuucuguccgggucugcccaacacguugaagagugcagcuguuauccucgcuaccccggagugagaugcgugugucgggauaacuggaagggcuccaaucgcccuauugucgacaucaacgugaaagacuacagcauuguuucuuccuaugugugcagcggccucgucggggauacacccagaaagaaugacucuagcuccucuagccauugucuggauccgaacaaugaagagggaggccacggggugaaaggaugggcuuucgacgauggcaacgacguuuggauggggcggaccaucuccgaaaagcugcgcagcggauacgagacguuuaaagugauugagggcuggucuaagccuaauuccaaacuccagaucaacagacaggucaucguggaucggggcaaucgcagcggguauucuggaauuuucuccgucgaaggcaagagcugcaucaacagauguuuuuacguggagcugauucgggggagaaagcaggaaacagagguucuuuggaccuccaauucuaucguggucuucugcggaaccagcggcacauaugggaccggcuccuggcccgacggagccgauauuaaccugaugccuaucuga

SEQ ID NO: 198987 - RNA, 1410 nt, Artificial Sequence; identical to SEQ ID NO: 197085
  derived and/or modified sequence opt5 from neuraminidase__InfluenzaA__ABU92843

SEQ ID NO: 198988 - RNA, 1410 nt, Artificial Sequence; identical to SEQ ID NO: 198773
  derived and/or modified sequence opt5 from neuraminidase__InfluenzaA__ABU92844

SEQ ID NO: 198989 - RNA, 1410 nt, Artificial Sequence; identical to SEQ ID NO: 197085
  derived and/or modified sequence opt5 from neuraminidase__InfluenzaA__ABU92845

SEQ ID NO: 198990 - RNA, 1410 nt, Artificial Sequence; identical to SEQ ID NO: 197085
  derived and/or modified sequence opt5 from neuraminidase__InfluenzaA__ABU92846

SEQ ID NO: 198991 - RNA, 1410 nt, Artificial Sequence; identical to SEQ ID NO: 197085
  derived and/or modified sequence opt5 from neuraminidase__InfluenzaA__ABU92847

SEQ ID NO: 198992 - RNA, 1410 nt, Artificial Sequence; identical to SEQ ID NO: 197085
  derived and/or modified sequence opt5 from neuraminidase__InfluenzaA__ABU92848

SEQ ID NO: 198993 - RNA, 1410 nt, Artificial Sequence; identical to SEQ ID NO: 197738
  derived and/or modified sequence opt5 from neuraminidase__InfluenzaA__ABU92849

SEQ ID NO: 198994 - RNA, 1410 nt, Artificial Sequence
  derived and/or modified sequence opt5 from neuraminidase__InfluenzaA__ABU92850
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucguggaguaccggaauugguccaagccccagugugacauuaccggguucgcuccuuuuucuaaagauaacagcauccgccuguccgccggaggcgacaucugggucacaagagagcccuaugugucuugcgauccugacaaguguuaccaauucgcgcuugggcagggaaccacacugaauaacguucauagcaaugauaccgugcacgaccggacgccguaucgcacacuccugaugaccgaacugggcguccccuuucaucucgggacaaaacaggugugcauugcuugguccucuagcuccugucacgauggaaaagccuggcugcauguuugcgugaccggcgacgauaagaacgccaccgcuagcuucaucuacaauggcagacuugucgacucuauuguguccuggagcaaaaagauccugcggacacaggagucugaaugugugugcauuaacgggacguguaccgucguuaugacagauggauccgccagcggcaaagcugacaccaagauccucuuuaucgaggaggggaagauugugcacacauccacccugucuggaagcgcccaacacguggaagagugcuccugcuauccucgcuaccccggcgucagaugugugugccgggauaauuggaaagggagcaaccgcccuaucguugacauuaacaucaaggacuacucuauuguguccagcuaugucuguucuggacuugugggcgauacgcccagaaagaaugacagcuccucuagcucccauugccuggauccgaacaaugaagagggcgggcacggaguuaagggcugggcguucgacgaugggaacgacguguggaugggacggacaaucagcgaaaaacuccgcucuggcuacgagaccuuuaaggucaucgaggggugguccaauccuaacagcaaacugcagauuaauagacaggugaucgucgaucggggaaaccgcucuggcuauuccggcauuuucagcguggaagggaaguccuguaucaauagaugcuuuuacguugagcugauucggggaagaaaggaagagaacgaagugcucuggaccucuaauagcaucgucguguucuguggcacauccgggaccuauggaacaggcucuuggcccgacggggccgauauuaaccugaugccuaucuga

SEQ ID NO: 198995 - RNA, 1410 nt, Artificial Sequence
  derived and/or modified sequence opt5 from neuraminidase__InfluenzaA__ABU92851
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguucuauuaccggguucgccccuuuuagcaaagacaacuccauccgccugucugcgggaggcgauaucugggugacaagagagcccuaugucagcugcgacccugauaaguguuaccaauucgcucuugggcagggaaccacacugaauaacgugcauuccaaugacaccguucacgaucggacgccguaucgcacacuccugaugaacgaacugggcgugcccuuucaucucgggaccaagcaggucugcauugccuggucuagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacauguacgguggucaugaccgacggaagcgcuuccggcaaggccgauacaaaaauccucuuuaucgaggaagggaagauuguucacaccucuacacugagcggauccgcgcaacacguggaggaaugcagcugcuauccucgcuaccccggcgugagaugugucugccgggacaacuggaaggggucuaaccgcccuaucguggauauuaauaucaaagacuacuccauuguuagcucuuauguguguagcggacuugucggcgacacccccagaaaggaugacuccucuagcuccagccauugccuggauccgaacaaugaggaaggcgggcacggagugaaaggcugggccuucgacgaugggaacgacguuuggaugggacggacgaucucugagaagucccgcagcggcuacgagacauuuaaagugaucgaaggguggucuaauccuaacuccaagcuccagauuaauagacaggucaucguggaucggggaaaccgcagcggcuauuccggcauuuucucugucgaggggaaaagcuguaucaauagaugcuuuuacguggaacugauucggggaagaaaggaggaaaccgagguucuguggaccuccaacucuaucguggucuucuguggcacaagcgggaccuauggaacaggcuccuggcccgacggggcugauauuaaucucaugccuaucuga

SEQ ID NO: 198996 - RNA, 1410 nt, Artificial Sequence; identical to SEQ ID NO: 197249
  derived and/or modified sequence opt5 from neuraminidase__InfluenzaA__ABU92852

SEQ ID NO: 198997 - RNA, 1410 nt, Artificial Sequence
  derived and/or modified sequence opt5 from neuraminidase__InfluenzaA__ABU92853
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaagaaucaggugaugcugugcgaacccaccaucauugagagaaacaucacagaaauuguguacaugaccaauacaaccaucgagaaagaaauuuguccuaagcucgcggaguaucggaacuggagcaaaccccagugcaauaucacgggguucgcuccuuuuuccaaggacaacucuauucgccugagcgccggaggcgauaucugggucaccagagagcccuacguguccugugacccugauaagugcuaucaauucgcccuugggcagggaacaacccugaauaacggccacucuaaugacacaguucaugaucggaccccguaccgcacgcuccugaugaacgaacugggggugcccuuucaccucggaacaagacaggucuguaucgcuuggagcuccagcucuugccaugacggcaaagccuggcugcacguguguguuaccggcgaugacaagaaugcuacagccuccuucauuuauaacgggcggcuuguggauagcaucgucucuugguccaaaaagauucugcgcacccaggagagcgaaugcguguguaucaauggaaccugcacaguggucaugacggacggcucugcguccgggaaagccgauaccaagauucucuuuaucgaggagggaaagaucguucacauuagcacacuguccggcucugcucaacauguggaagagugcagcuguuacccuagauaucccggggugcggugcgucugucgcgacaacuggaaaggauccaacagaccuaucguggauauuaauguuaaggacuacagcaucgugucuuccuacgucugcagcggccuugugggcgacacaccccggaaaaacgauucuuucagcuccucucacugucuggacccgaauaacgaagaagggggacauggcguuaaggggugggccuuugaugacggaaaugauguguggaugggccgcaccauuagcgagaaacucagauccggguaugagaccuucaaggucaucgagggauggagcaaaccuaacucuaagcugcagaucaaucgccaggugauugucgaacggggcaacagauccggcuacagcgggaucuuuucuguggagggaaaguccugcauuaaucgguguuucuauguugaacugaucagaggccgcaaagaggaaacggaggugugguggacaagcaacuccauugucguguuuugcgggaccucuggaaccuacggcacagggagcuggcccgacggcgcugauaucaaucucaugccuauuuga

SEQ ID NO: 198998 - RNA, 1410 nt, Artificial Sequence; identical to SEQ ID NO: 197249
  derived and/or modified sequence opt5 from neuraminidase__InfluenzaA__ABU92854

SEQ ID NO: 198999 - RNA, 1410 nt, Artificial Sequence
  derived and/or modified sequence opt5 from neuraminidase__InfluenzaA__ABU92855
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuaucgaacgcggcaauagauccggguacagcggaaucuuuucuguggagggcaaguccugcauuaaccgguguuucuaugucgaacucauuagagggcgcaaggaggaaacggaggugugguggacaagcaauuccaucguuguguuuugcggaaccucuggcaccuacgggacaggcagcuggcccgacggagcugauauuaaccugaugccuaucuga

SEQ ID NO: 199000 - RNA, 1410 nt, Artificial Sequence; identical to SEQ ID NO: 197169
  derived and/or modified sequence opt5 from neuraminidase__InfluenzaA__ABU92856

SEQ ID NO: 199001 - RNA, 1410 nt, Artificial Sequence; identical to SEQ ID NO: 197249
  derived and/or modified sequence opt5 from neuraminidase__InfluenzaA__ABU92857

SEQ ID NO: 199002 - RNA, 1410 nt, Artificial Sequence
  derived and/or modified sequence opt5 from neuraminidase__InfluenzaA__ABU92858
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuauucuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcaucgccugguccucuagcuccugucacgauggaaaagccuggcugcaugugugcguuacaggcgacgauaagaaugcuaccgccagcuucauuuacaacggcagacuuguggacucuaucgucuccuggagcaaaaagauucugcggacccaggagucugaaugugugugcaucaaugggacauguacgguggucaugaccgauggauccgcuagcggcaaagccgacacaaagauccucuuuauugaggaggggaagaucguucacaccuccacacugucuggaagcgcgcaacacguggaagagugcuccugcuauccucgcuaccccggcgugagaugugucugccgggauaacuggaaagggagcaaccgcccuauuguggacaucaauauuaaggacuacucuaucguuuccagcuauguguguucuggacuugucggcgauacccccagaaagaacgacagcuccucuagcucccauugccuggauccgaauaacgaagagggcgggcacggagugaaaggcugggccuucgacgaugggaaugacguuuggaugggacggacgaucagcgaaaaacuccgcucuggcuacgagacauuuaaggugauugaggggugguccaacccuaauagcaaacugcagaucaacagacaggucauuguggaucggggaaaucgcucuggcuauuccggcaucuucagcgucgaagggaaguccuguauuaacagaugcuuuuacguggagcugauccggggaagaaaggaagagaccgaaguucucuggaccucuaauagcauuguggucuucuguggcacauccgggaccuauggaacaggcucuuggcccgacggggcugauaucaaccugaugccuaucuga

SEQ ID NO: 199003 - RNA, 1410 nt, Artificial Sequence
  derived and/or modified sequence opt5 from neuraminidase__InfluenzaA__ABU92859
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcgggguaucggaauuggagcaagccccagugcaacaucacgggauucgcuccuuuuuccaaagacaauucuauucgccuuagcgccggcggggauaucugggucaccagagagcccuacguguccugugacccugauaagugcuaucaauucgcccugggacagggcacaacccucaacaaugggcacucuaacgacacaguucaugaucggaccccguaccgcacgcugcugaugaaugagcucggagugcccuuucaccugggcacaagacaggucuguaucgcuuggagcuccagcucuugccaugacggcaaggccuggcuucacguguguguuaccggggaugacaaaaacgcuacagccuccuucauuuauaauggacggcugguggauagcaucggcucuugguccaagaaaauucuccgcacccaggaaagcgagugcgucuguaucaacgggaccugcacaguggugaugacggacggaucugcguccggcaaggccgauaccaaaauucuguuuaucgaagaggggaagaucguccacauuagcacacuuuccggaucugcucaacauguugaggaaugcagcuguuacccuagauaucccggcgugcggugcgugugucgcgacaacuggaagggcuccaauagaccuaucgucgauauuaacgugaaagacuacagcaucguuucuuccuacgugugcagcgggcuggucggagacacaccccggaagaaugauucuuucagcuccucucacugucucgacccgaacaaugaggaaggcgggcauggagugaaaggcugggccuuugaugacgggaacgauguuuggaugggacgcaccauuagcgagaagcugagauccggcuaugaaaccuucaaagugaucgagggcuggagcaagccuaauucuaaacugcagaucaaccggcaggucauuguggagcgcgggaauagauccggauacagcggcaucuuuucugucgaagggaaguccugcauuaaccgguguuucuauguggagcucaucagaggacgcaaggaagagacggaaguuugguggacaagcaauuccauuguggucuuuugcggcaccucugggaccuacggcacaggaagcuggcccgacggcgcugauaucaaccugaugccuauuuga

SEQ ID NO: 199004 - RNA, 1410 nt, Artificial Sequence
  derived and/or modified sequence opt5 from neuraminidase__InfluenzaA__ABU92860
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguacaagaaaauucuccgcacccaggaguccgaaugcgucuguaucaacgggaccugcacaguggugaugacggacggcagcgcgucuggaaaggccgauaccaaaauucuguuuaucgaggagggcaagaucguccacauuuccacacuuagcggguccgcucaacauguugaagagugcucuuguuauccuagauaccccggagugcggugcgugugucgcgacaacuggaagggcagcaauagaccuaucgucgauauuaacgugaaagacuacuccaucauuagcucuuauguuugcuccggccuggugggggacacaccccggaagaaugauagcuucucuagcucccacugucucgacccgaacaaugaagagggaggccauggggucaaaggaugggccuuugaugacggcaacgauguguggauggggcgcaccaucucugaaaagcugagaagcggauacgagaccuucaaaguuaucgagggcugguccaagccuaauagcaaacugcagauuaaccgccaggugaucgucgaacggggcaauagaucuggguauuccggaauuuuuagcguggagggcaagucuugcaucaaccgguguuucuacgucgaacucauuagagggcgcaaggaggaaacggaggugugguggacauccaauagcaucguuguguuuugcggaaccuccggcaccuaugggacaggcucuuggcccgacggagcugauauuaaccugaugccuaucuga

SEQ ID NO: 199005 - RNA, 1410 nt, Artificial Sequence
  derived and/or modified sequence opt5 from neuraminidase__InfluenzaA__ABU92861
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguauggcuuggagcuccagcucuugccaugacggcaaggccuggcuucacguguguguuaccggcgaugacaaaaacgcuacagccuccuucaucuauaaugggcggcugguggauagcauuggaucuugguccaagaaaauccuccgcacccaggagagcgaaugcgucuguauuaacgggaccugcacaguggugaugacggacggcucugcguccggaaaggccgauaccaaaauccuguuuauugaggagggcaagaucguccacaucagcacacuuuccgggucugcucaacauguugaagagugcagcuguuacccuagauaucccggagugcggugcgugugucgcgacaacuggaagggcuccaauagaccuauugucgauaucaacgugaaagacuacagcauuguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccaucagcgaaaagcugagauccggauaugagaccuucaaagugauugagggcuggagcaagccuaauucuaaacugcagaucaaccggcaggucaucguggaacgcggcaauagauccggguacagcggaaucuuuucugucgagggcaaguccugcauuaaccgguguuucuauguggaacucauuagagggcgcaaggaggaaacggagguuugguggacaagcaauuccaucguggucuuuugcggaaccucuggcaccuacgggacaggcagcuggcccgacggagcugauauuaaccugaugccuaucuga

SEQ ID NO: 199006 - RNA, 1410 nt, Artificial Sequence
  derived and/or modified sequence opt5 from neuraminidase__InfluenzaA__ABU92862
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuucccgcgacaauucuauuagacuuagcgccggaggcgauaucugggucacccgggagcccuacguguccugugacccugauaaaugcuaucaauucgcccuggggcagggaacaacccucaacaauggccacucuaacgacacaguucaugaucgcaccccguacagaacgcugcugaugaaugaacucggggugcccuuucaccugggaacacggcaggucuguaucgcuuggagcuccagcucuugccaugacggcaaggccuggcuucacguguguguuaccggcgaugacaagaacgcuacagccuccuucauuuauaaugggcgccugguggauagcaucggaucuugguccaaaaagauucucagaacccaggagagcgaaugcgucuguaucaacgggaccugcacaguggugaugacggacggcucugcguccggaaaagccgauaccaagauucuguuuaucgaggagggcaaaaucguccacauuagcacacuuuccgggucugcucaacauguugaagagugcagcuguuacccucgguaucccggagugcgcugcguguguagagacaacuggaagggcuccaaucggccuaucgucgauauuaacgugaaggacuacagcaucguuucuuccuacgugugcagcggccuggucggggacacaccccgcaaaaaugauucuuucagcuccucucacugucucgacccgaacaaugaagagggaggccauggggugaagggaugggccuuugaugacggcaacgauguuuggauggggagaaccauuagcgaaaaacugcgguccggauaugagaccuucaaggugaucgagggcuggagcaaaccuaauucuaagcugcagaucaaccgccaggucauuguggaaagaggcaaucgguccggguacagcggaaucuuuucugucgagggcaaauccugcauuaacagauguuucuauguggaacucauccgcgggcggaaggaggaaacggagguuugguggacaagcaauuccauuguggucuuuugcggaaccucuggcaccuacgggacaggcagcuggcccgacggagcugauaucaaccugaugccuauuuga

SEQ ID NO: 199007 - RNA, 1410 nt, Artificial Sequence; identical to SEQ ID NO: 197249
  derived and/or modified sequence opt5 from neuraminidase__InfluenzaA__ABU92863

SEQ ID NO: 199008 - RNA, 1410 nt, Artificial Sequence
  derived and/or modified sequence opt5 from neuraminidase__InfluenzaA__ABU92865
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgaucuugacaaguguuaccaauucgcucuggggcagggaaccacacucaauaacgugcauagcaaugauaccguucacgaccggacgccuuaucgcacacugcugaugaacgaacucggcgugccguuucaucuggggaccaagcaggucugcauugccugguccucuagcuccugucacgauggaaaagccuggcuucaugugugcguuacaggcgacgauaagaaugcuaccgccagcuucaucuacaacggcagacugguggacucuauugucuccuggagcaaaaagauccuccggacccaggagucugaaugugugugcauuaaugggacauguacgguggucaugaccgauggauccgcuagcggcaaagccgacacaaagauccuguuuaucgaggaggggaagauuguucacaccuccacacuuucuggaagcgcgcaacacguggaagagugcuccugcuauccccgcuacccuggcgugagaugugucugccgggauaacuggaaagggagcaaccgccccaucguggacauuaauaucaaggacuacucuauuguuuccagcuauguguguucuggacuggucggcgauaccccucggaaaaacgacagcuccucuagcucccauugccucgaucccaauaacgaagagggcgggcacggagugaagggcugggccuucgacgaugggaaugacguuuggaugggaagaacgaucagcgaaaaacugcgcucuggcuacgagacauuuaaggugaucgaggggugguccaacccgaauagcaaacugcagauuaacagacaggucaucguggaucggggaaaucgcucuggcuauuccggcauuuucagcgucgaagggaaguccuguaucaacagaugcuuuuacguggagcucauucggggaagaaaggaagagaccgaaguucuguggaccucuaauagcaucguggucuucuguggcacauccgggaccuauggaacaggcucuuggccugacggggcugauauuaaccuuaugcccaucuga

SEQ ID NO: 199009 - RNA, 1410 nt, Artificial Sequence
  derived and/or modified sequence opt5 from neuraminidase__InfluenzaA__ABU92866
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcacgaccggacgccguaucgcacacuccugaugaacgaacugggcguccccuuucaucucgggaccaaacaggugugcaucgccugguccucuagcuccugucacgauggaaaggccuggcugcauguuugcgugacaggcgacgauaagaaugcuaccgccagcuucauuuacaacggcagacuugucgacucuaucguguccuggagcaaagagauucugcggacccaggaaucugagugugugugcaucaaugggacauguacggucguuaugaccgauggauccgcuagcggcaaggccgacacaaaaauucucuuuaucgaggaagggaagaucgugcacaccuccacacugucuggaagcgcgcaacacguggaggaaugcuccugcuauccucgcuaccccggcgucagaugugugugccgggauaacuggaaggggagcaaccgcccuauuguugacaucaauauuaaagacuacucuaucguguccagcuaugucuguucuggacuugugggcgauacccccagaaagaacgacagcuccucuaauagccauugccuggauccgaacaaugaggaaggcgggcacggaguuaaaggcugggccuucgacgaugggaacgacguguggaugggacggacgauuuccgagaagcuccgcagcggcuacgagacauuuaaagucaucgaaggguggucuaauccuaacuccaagcugcagaucaauagacaggugauugucgaucggggaaaccgcagcggcuauucuggcaucuucuccguggaggggaaaagcuguauuaauagaugcuuuuacguugaacugauccggggaagaaaggaggaaaccgaggugcucuggaccuccaacucuauugucguguucuguggcacaagcgggaccuauggaacaggcuccuggcccgacggggcugauaucaaucugaugccuauuuga

SEQ ID NO: 199010 - RNA, 1410 nt, Artificial Sequence; identical to SEQ ID NO: 197831
  derived and/or modified sequence opt5 from neuraminidase__InfluenzaA__ABU92867

SEQ ID NO: 199011 - RNA, 1410 nt, Artificial Sequence; identical to SEQ ID NO: 198938
  derived and/or modified sequence opt5 from neuraminidase__InfluenzaA__ABU92868

SEQ ID NO: 199012 - RNA, 1410 nt, Artificial Sequence; identical to SEQ ID NO: 197718
  derived and/or modified sequence opt5 from neuraminidase__InfluenzaA__ABU92869

SEQ ID NO: 199013 - RNA, 1410 nt, Artificial Sequence; identical to SEQ ID NO: 198908
  derived and/or modified sequence opt5 from neuraminidase__InfluenzaA__ABU92870

SEQ ID NO: 199014 - RNA, 1410 nt, Artificial Sequence
  derived and/or modified sequence opt5 from neuraminidase__InfluenzaA__ABU92872
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacaauaucguuagcucuuacgugugcuccggccuggucggggacacaccccggaagaacgauagcuucucuagcucccacugucucgacccgaauaacgaagagggaggccauggggugaaaggaugggccuuugaugacggcaaugauguuuggauggggcgcaccauuucugaaaagcugagaagcggauaugagaccuucaaagugaucgagggcugguccaagccuaacagcaaacugcagaucaaucggcaggucauuguggaacgcggcaacagaucuggguacuccggaaucuuuagcgucgagggcaagucuugcauuaaucgguguuucuauguggaacucaucagagggcgcaaggaggaaacggagguuugguggacauccaacagcauuguggucuuuugcggaaccuccggcaccuacgggacaggcucuuggcccgacggagcugauaucaaucugaugccuauuuga

SEQ ID NO: 199015 - RNA, 1410 nt, Artificial Sequence
  derived and/or modified sequence opt5 from neuraminidase__InfluenzaA__ABU92873
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaagcaggagaccgaaguucucuggaccucuaacagcaucguggucuucuguggcacauccgggaccuauggaacaggcucuuggcccgauggggcugacauuaauaucaugccuaucuga

SEQ ID NO: 199016 - RNA, 1410 nt, Artificial Sequence; identical to SEQ ID NO: 198953
  derived and/or modified sequence opt5 from neuraminidase__InfluenzaA__ABU92874

SEQ ID NO: 199017 - RNA, 1410 nt, Artificial Sequence; identical to SEQ ID NO: 197249
  derived and/or modified sequence opt5 from neuraminidase__InfluenzaA__ABU92875

SEQ ID NO: 199018 - RNA, 1410 nt, Artificial Sequence; identical to SEQ ID NO: 197249
  derived and/or modified sequence opt5 from neuraminidase__InfluenzaA__ABU92876

SEQ ID NO: 199019 - RNA, 1410 nt, Artificial Sequence; identical to SEQ ID NO: 197169
  derived and/or modified sequence opt5 from neuraminidase__InfluenzaA__ABU92877

SEQ ID NO: 199020 - RNA, 1410 nt, Artificial Sequence; identical to SEQ ID NO: 197249
  derived and/or modified sequence opt5 from neuraminidase__InfluenzaA__ABU92878

SEQ ID NO: 199021 - RNA, 1410 nt, Artificial Sequence
  derived and/or modified sequence opt5 from neuraminidase__InfluenzaA__ABU92879
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaaaauucuccgcacccaggagagcgaaugcgucuguaucaacggcacaugcacgguggugaugaccgacgggucugccuccggaaaggcggauacaaaaauucuguuuaucgaggagggcaagaucguccacauuagcacccuuuccgggucugcccaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccauuagcgaaaagcugagauccggauaugagacguucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaagggagagacagaaguuugguggaccagcaauuccauuguggucuuuugcggcaccucugggacauacggcaccggaagcuggcccgacggcgccgauaucaaccugaugccuauuuga

SEQ ID NO: 199022 - RNA, 1410 nt, Artificial Sequence; identical to SEQ ID NO: 199014
  derived and/or modified sequence opt5 from neuraminidase__InfluenzaA__ABU92880

SEQ ID NO: 199023 - RNA, 1410 nt, Artificial Sequence; identical to SEQ ID NO: 197249
  derived and/or modified sequence opt5 from neuraminidase__InfluenzaA__ABU92881

SEQ ID NO: 199024 - RNA, 1410 nt, Artificial Sequence; identical to SEQ ID NO: 197249
  derived and/or modified sequence opt5 from neuraminidase__InfluenzaA__ABU92882

SEQ ID NO: 199025 - RNA, 1410 nt, Artificial Sequence
  derived and/or modified sequence opt5 from neuraminidase__InfluenzaA__ABU92883
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaagaaucaggugaugcugugcgaacccaccaucauugagagaaacaucacagaaauuguguaccucaccaauacaaccaucgagaaagaaauuuguccuaagcuggcggaguaucggaacuggagcaaaccccagugcaauaucacgggguucgcuccuuuuuccaaggacaacucuauucgccuuagcgccggaggcgauaucugggucaccagagagcccuacguguccugugacccugauaagugcuaucaauucgcccuggggcagggaacaacccucaauaacggccacucuaaugacacaguucaugaucggaccccguaccgcacgcugcugaugaacgaacucggggugcccuuucaccugggaacaagacaggucuguaucgcuuggagcuccagcucuugccaugacggcaaagccuggcuucacguguguguuaccggcgaugacaagaaugcuacagccuccuucauuuauaacgggcggcugguggauagcaucgucucuugguccaaaaagauucuccgcacccaggagagcgaaugcguguguaucaauggaaccugcacaguggucaugacggacggcucugcguccgggaaagccgauaccaagauucuguuuaucgaggagggaaagaucguucacauuagcacacuuuccggcucugcucaacauguggaagagugcagcuguuacccuagauaucccggggugcggugcgucugucgcgacaacuggaaaggauccaacagaccuaucguggauauuaauguuaaggacuacagcaucgugucuuccuacgucugcagcggccuggugggcgacacaccccggaaaaacgauucuuucagcuccucucacugucucgacccgaauaacgaagaagggggacauggcguuaaggggugggccuuugaugacggaaaugauguguggaugggccgcaccauuagcgagaaacugagauccggguaugagaccuucaaggucaucgagggauggagcaaaccuaacucuaagcugcagaucaaucgccaggugauugucgaacggggcaacagauccggcuacagcgggaucuuuucuguggagggaaaguccugcauuaaucgguguuucuauguugaacucaucagaggccgcaaagaggaaacggaggugugguggacaagcaacuccauugucguguuuugcgggaccucuggaaccuacggcacagggagcuggcccgacggcgcugauaucaaucugaugccuauuuga

SEQ ID NO: 199026 - RNA, 1410 nt, Artificial Sequence; identical to SEQ ID NO: 197249
  derived and/or modified sequence opt5 from neuraminidase__InfluenzaA__ABU92884

SEQ ID NO: 199027 - RNA, 1410 nt, Artificial Sequence; identical to SEQ ID NO: 197249
  derived and/or modified sequence opt5 from neuraminidase__InfluenzaA__ABU92885

SEQ ID NO: 199028 - RNA, 1410 nt, Artificial Sequence; identical to SEQ ID NO: 197738
  derived and/or modified sequence opt5 from neuraminidase__InfluenzaA__ABU92886

SEQ ID NO: 199029 - RNA, 1410 nt, Artificial Sequence; identical to SEQ ID NO: 197249
  derived and/or modified sequence opt5 from neuraminidase__InfluenzaA__ABU92887

SEQ ID NO: 199030 - RNA, 1410 nt, Artificial Sequence
  derived and/or modified sequence opt5 from neuraminidase__InfluenzaA__ABU92888
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucuauugucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuaucuccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuguggaagggugguccaauccuaacagcaagcugcagauuaauagacaggucaucguggaccgggauaaccgcucuggauauuccggcauuuucagcgucgagggcaaauccuguaucaauagaugcuuuuacguggaacugauucgggggagaaaccaggagaccgaaguucucuggaccucuaauagcaucguggucuucuguggaacauccggcaccuaugggacaggaucuuggcccgacggcgcugauauuaaccugaugccuaucuga

SEQ ID NO: 199031 - RNA, 1410 nt, Artificial Sequence; identical to SEQ ID NO: 198953
  derived and/or modified sequence opt5 from neuraminidase__InfluenzaA__ABU92889

SEQ ID NO: 199032 - RNA, 1410 nt, Artificial Sequence
  derived and/or modified sequence opt5 from neuraminidase__InfluenzaA__ABU92890
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucguuagagggcgcaaggaggaaacggaggugugguggacaagcaauuccaucgucguguuuugcggaaccucuggcaccuacgggacaggcagcuggcccgacggagcugauauuaaccugaugccuaucuga

SEQ ID NO: 199033 - RNA, 1410 nt, Artificial Sequence; identical to SEQ ID NO: 198969
  derived and/or modified sequence opt5 from neuraminidase__InfluenzaA__ABU92891

SEQ ID NO: 199034 - RNA, 1410 nt, Artificial Sequence
  derived and/or modified sequence opt5 from neuraminidase__InfluenzaA__ABU92892
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcaauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaaaagauccugcggacccaggagucugaaugugugugcauuaacgggacauguacgguggucaugaccgacggauccgcuagcggcaaagccgauacaaagauccucuuuaucgaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaaaggcugggccuucgaugacgggaacgauguuuggaugggacggacgaucagcgaaaaacuccgcucuggcuacgagacauuuaaggugaucgaggggugguccaauccuaacagcaaacugcagauuaauagacaggucaucguggaccggggaaaccgcucuggcuauuccggcauuuucagcgucgaagggaaguccuguaucaauagaugcuuuuacguggagcugauucggggaagaaaggaagagaccgaaguucucuggaccucuaacagcaucguggucuucuguggcacauccgggaccuauggaacaggcucuuggcccgauggggcugacauuaaucugaugccuaucuga

SEQ ID NO: 199035 - RNA, 1410 nt, Artificial Sequence; identical to SEQ ID NO: 197831
  derived and/or modified sequence opt5 from neuraminidase__InfluenzaA__ABU92893

SEQ ID NO: 199036 - RNA, 1410 nt, Artificial Sequence
  derived and/or modified sequence opt5 from neuraminidase__InfluenzaA__ABU92895
augaaccccaaucagaagaucauuaccgugggcagcgucucccugacaaucucuacgauuugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcacgaccggacgccguaucgcacacuccugaugaacgaacugggcguccccuuucaucucgggaccaaacaggugugcaucgccugguccucuagcuccugucacgauggaaaggccuggcugcauguuugcgugacaggcgacgauaagaaugcuaccgccagcuucauuuacaacggcagacuugucgacucuaucguguccuggagcaaagagauucugcggacccaggaaucugagugugugugcaucaaugggacauguacggucguuaugaccgauggauccgcuagcggcaaggccgacacaaaaauucucuuuaucgaggaagggaagaucgugcacaccuccacacugucuggaagcgcgcaacacguggaggaaugcuccugcuauccucgcuaccccggcgucagaugugugugccgggauaacuggaaggggagcaaccgcccuauuguugacaucaauauuaaagacuacucuaucgccuccagcuauguguguucuggacuugucggcgauacccccagaaagaacgacagcuccucuagcucccauugccuggauccgaauaacgaggaaggcgggcacggagugaaaggcugggcuuucgacgaugggaaugacguuuggaugggacggacgauuagcgagaagcuccgcucuggcuacgagacauuuaaagugaucgaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggaccucuaauagcauuguggucuucuguggcacauccgggaccuauggaacaggcucuuggcccgacggggccgauaucaaccugaugccuauuuga

SEQ ID NO: 199037 - RNA, 1410 nt, Artificial Sequence
  derived and/or modified sequence opt5 from neuraminidase__InfluenzaA__ABU92896
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcaaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugaccgcaacgauguguggauggggagaaccaucagcgagaagucucggcucggauaugagacauuuaaaguuauugaaggcugguccaauccuaacagcaagcugcagaucaaucgccaggugauugucgacagagggaaccggucuggauacuccggcaucuucagcguggagggcaaauccuguauuaauagaugcuuuuaugucgaacugauccgcgggcggaaggaggaaaccgaggugcucuggaccucuaacagcauuguuguguucuguggaacauccggcaccuacgggacaggaucuuggcccgauggcgcugacaucaaucugaugccuaucuga

SEQ ID NO: 199038 - RNA, 1410 nt, Artificial Sequence
  derived and/or modified sequence opt5 from neuraminidase__InfluenzaA__ABU92897
augaaccccaaucagaagaucauuaccaucggcagcgugucccugacaauuucuacgaucugcuucuuuaugcaaauugccauccucaucaccacagucacccugcacuucaaacaguacgagcuuaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccaguguaacauuaccggguuugccccuuucucuaaagacaauagcauccgccuuuccgcgggaggcgauaucugggugacaagagagcccuaugucucuugcgacccugauaaguguuaccaauuugcucuggggcagggaaccacacucaacaaugugcauagcaacgacaccguucacgaucggacgccguaucgcacacugcugaugaaugaacucggcgugcccuuccaucuggggaccaagcaggucugcauugccugguccuccucuuccugucacgacggaaaagccuggcuucaugugugcguuacaggcgaugacaagaacgcuaccgccagcuuuaucuacaauggcagacugguggauucuauugucuccuggagcaaagagauccuccggacccaggaaucugagugugugugcauuaacgggacauguacgguggucaugaccgacggauccgcuagcggcaaggccgauacaaaaauccuguucaucgaggaagggaagauuguucacaccuccacacuuucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuggucggcgacacccccagaaagaaugauagcuccucuagcucccauugccucgacccgaacaaugaggaaggcgggcacggagugaaaggcugggccuuugaugacgggaacgauguuuggaugggacggacgaucagcgagaagucucgcuccggcuacgagacauucaaagugaucgaaggguggagcaauccuaacucuaagcugcagauuaauagacaggucaucguggaccggggaaaccgcuccggcuauagcggcauuuuuagcgucgaggggaaaucuuguaucaauagaugcuucuacguggaacugauucggggaagaaaggaggaaaccgagguucucuggaccagcaacuccaucguggucuuuuguggcacaucugggaccuauggaacaggcagcuggcccgauggggcugacauuaaucugaugccuaucuga

SEQ ID NO: 199039 - RNA, 1410 nt, Artificial Sequence
  derived and/or modified sequence opt5 from neuraminidase__InfluenzaA__ABU92898
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacaccuccacacugucuggaagcgcgcaacacguggaagagugcuccugcuauccucgcuaccccggcgucagaugugugugccgggacaacuggaaggggagcaaccgcccuauuguugacaucaauauuaaaaacuacucuaucguguccagcuaugucuguucuggacuugugggcgauacccccagaaagacggacagcuccucuagcucccauugccuggauccgaauaacgaagagggcgggcacggaguuaaaggcugggccuucgacgaugggaaugacguguggaugggacggacaauuagcgaaaagcuccgccugggcuacgagaccuuuaaagucaucgagggguggucuaacccuaauuccaagcugcagaucaacagacaggugauugucgaucggggaaaucgcaccggcuauagcggcaucuucucuguggaagggaaauccuguauuaacagaugcuuuuacguugagcucauccggggaagaaaggaagagacagaagugcuguggaccagcaauuccauugucguguucuguggcacaucugggacguauggaaccggcagcuggcccgacggggcugauaucaaccuuaugccuauuuga

SEQ ID NO: 199040 - RNA, 1410 nt, Artificial Sequence; identical to SEQ ID NO: 197249
  derived and/or modified sequence opt5 from neuraminidase__InfluenzaA__ABU92899

SEQ ID NO: 199041 - RNA, 1410 nt, Artificial Sequence
  derived and/or modified sequence opt5 from neuraminidase__InfluenzaA__ABU92900
augaaccccaaucagaagaucauuaccaucggcagcgugucccugacaauugccgcuaucugcuuccucaugcaaauugccauccuggucacgaccguuacacuucacuuuaaacagcaugaguguaacccuccgcccaauaaccaggugaugcugugcgaaccuaccaucauugagagaaauaucacagaaauuguguaccucaccaacacaaccaucgagaaggaaauuugucccaaacuggcggaguaucggaauuggucuaagccucagugcaacaucacgggguucgcucccuuuagcaaagacaauuccauucgccuuucugccggaggcgauaucugggucaccagagagccuuacgugagcugugacccggauaagugcuaucaauucgcccuggggcagggaacaacccucaacaauggccacuccaacgacacaguucaugaucggacccccuaccgcacgcugcugaugaaugaacucggggugccuuuucaccugggaacaagacaggucuguaucgcuuggucuagcuccagcugccaugacggcaaggccuggcuucacguguguguuaccggcgaugacaaaaacgcuacagccucuuucauuuauaaugggcggcugguggauuccaucggaagcuggucuaagaaaauucuccgcacccaggaguccgaaugcgucuguaucaacgggaccugcacaguggugaugacggacggcagcgcgucuggaaaggccgauaccaaaauucuguuuaucgaggagggcaagaucguccacauuuccacacuuagcggguccgcucaacauguugaagagugcucuuguuaccccagauauccuggagugcggugcgugugucgcgacaacuggaagggcagcaauagacccaucgucgauauuaacgugaaagacuacuccaucguuagcucuuacgugugcuccggccuggucggggacaccccgcggaagaaugauagcuucucuagcucccacugucucgacccuaacaaugaagagggaggccauggggugaaaggaugggccuuugaugacggcaacgauguuuggauggggcgcacaauuucugaaaagcugagaagcggauaugagaccuucaaagugaucgagggcugguccaagcccaauagcaaacugcagaucaaccggcaggucauuguggaacgcggcaauagaucuggguacuccggaaucuuuagcgucgagggcaagucuugcauuaaccgguguuucuauguggaacucaucagagggcgcaaggaggaaacggagguuugguggacauccaauagcauuguggucuuuugcggaaccuccggcaccuacgggacaggcucuuggccugacggagcugauaucaaccugaugcccauuuga

SEQ ID NO: 199042 - RNA, 1410 nt, Artificial Sequence
  derived and/or modified sequence opt5 from neuraminidase__InfluenzaA__ABU92901
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucucuuccuggagcaagaaaauucuccgcacccaggagucugaaugcgucuguaucaacggaaccugcacaguggugaugacggacggcuccgcgagcgggaaggccgauaccaaaauucuguuuaucgaggagggaaagaucguccacauuuccacacuuucuggcagcgcucaacauguugaagagugcuccuguuacccuagauaucccggggugcggugcgugugucgcgacaacuggaagggaagcaauagaccuaucgucgauauuaacgugaaagacuacucuaucguuuccagcuacgugugcucuggccuggucggcgacacaccccggaagaaugauagcuucuccucuagccacugucucgacccgaacaaugaagaagggggacauggcgugaaagggugggccuuugaugacggaaacgauguuuggaugggccgcaccauuuccgagaagcugagaagcggguaugagaccuucaaagugaucgagggauggucuaagccuaauuccaaacugcagaucaaccggcaggucauuguggaacgcggcaauagaagcggcuacucugggaucuuuuccgucgagggaaagagcugcauuaaccgguguuucuauguggaacucaucagaggccgcaaggaggaaacggagguuugguggacauccaauucuauuguggucuuuugcgggaccagcggaaccuacggcacaggguccuggcccgacggcgcugauaucaaccugaugccuauuuga

SEQ ID NO: 199043 - RNA, 1410 nt, Artificial Sequence; identical to SEQ ID NO: 197249
  derived and/or modified sequence opt5 from neuraminidase__InfluenzaA__ABU92902

SEQ ID NO: 199044 - RNA, 1410 nt, Artificial Sequence; identical to SEQ ID NO: 197249
  derived and/or modified sequence opt5 from neuraminidase__InfluenzaA__ABU92903

SEQ ID NO: 199045 - RNA, 1410 nt, Artificial Sequence; identical to SEQ ID NO: 198204
  derived and/or modified sequence opt5 from neuraminidase__InfluenzaA__ABU92904

SEQ ID NO: 199046 - RNA, 1410 nt, Artificial Sequence; identical to SEQ ID NO: 197249
  derived and/or modified sequence opt5 from neuraminidase__InfluenzaA__ABU92905

SEQ ID NO: 199047 - RNA, 1410 nt, Artificial Sequence
  derived and/or modified sequence opt5 from neuraminidase__InfluenzaA__ABU92906
augaaccccaaucagaagaucauuaccaucggcagcgugucccugacaauugccgcuaucugcuuccucaugcaaauugccauccuggucacgaccguuacacuucacuuuaaacagcaugaguguaacucuccuccgaauaaccaggugaugcugugcgaacccaccaucauugagagaaauaucacagaaauuguguaccucaccaacacaaccaucgagaaggaaauuuguccuaaacuggcggaguaucggaauuggagcaagccccagugcaacaucacgggguucgcuccuuuuuccaaagacaauucuauucgccuuagcgccggaggcgauaucugggucaccagagagcccuacguguccugugacccugauaagugcuaucaauucgcccuggggcagggaacaacccucaacaauggccacucuaacgacacaguucaugaucggaccccguaccgcacgcugcugaugaaugaacucggggugcccuuucaccugggaacaagacaggucuguaucgcuuggagcuccagcucuugccaugacggcaaggccuggcuucacguguguguuaccggcgaugacaaaaacgcuacagccuccuucauuuauaaugggcggcugguggauagcaucggaucuugguccaagaaaauucuccgcacccaggagagcgaaugcgucuguaucaacgggaccugcacaguggugaugacggacggcucugcguccggaaaggccgauaccaaaauucuguuuaucgaggagggcaagaucguccacauuagcacacuuuccgggucugcucaacauguugaagagugcagcuguuacccuagauaucccggagugcggugcgugugucgcgacaacuggaagggcuccaauagaccuaucgucgauauuaacgugaaagacuacagcaucguuucuuccuacgugugcagcggccuggucggggacacaccccggaagaaugauucuuucagcuccucucacugucucgacccgaacaaugaagagggaggccauggggugaaaggaugggccuuugaugacggcaacgauguuuggauggggcgcaccauuagcgaaaagcugagauccggauaugagaccuucaaagugaucgagggcuggagcaagccuaauucuaaacugcagaucaaccggcaggucauuguggaacgcggcaauagauccggguacagcggaaucuuuucugucgagggcaaguccugcauuaaccgguguuucuauguggaacucaucagagggcgcaaggaggaaacggagguuugguggacaagcaauuccauuguggucuuuugcggaaccucuggcaccuacgggacaggcagcuggcccgacggagcugauaucaaacugaugccuauuuga

SEQ ID NO: 199048 - RNA, 1410 nt, Artificial Sequence
  derived and/or modified sequence opt5 from neuraminidase__InfluenzaA__ABU92907
augaaccccaaucagaagaucauuaccaucggcagcauuucccugacaaucgccgcuauuugcuuccucaugcaaaucgccauccuggugacgaccgucacacuucacuuuaaacagcaugaguguaacucuccuccgaauaaccagguuaugcugugcgaacccaccauuaucgagagaaauauuacagaaaucguguaccucaccaacacaaccauugagaaggaaaucuguccuaaacuggcggaguaucggaauuggagcaagccccagugcaacauuacgggguucgcuccuuuuuccaaagacaauucuauccgccuuagcgccggaggcgauaucugggugaccagagagcccuacgucuccugugacccugauaagugcuaucaauucgcccuggggcagggaacaacccucaacaauggccacucuaacgacacagugcaugaucggaccccguaccgcacgcugcugaugaaugaacucgggguucccuuucaccugggaacaagacagguguguauugcuuggagcuccagcucuugccaugacggcaaggccuggcuucacgucugugugaccggcgaugacaaaaacgcuacagccuccuucaucuauaaugggcggcugguugauagcauuggaucuugguccaagaaaauccuccgcacccaggagagcgaaugcguguguauuaacgggaccugcacagucgugaugacggacggcucugcguccggaaaggccgauaccaaaauccuguuuaucgaggagggcaagauugugcacaucagcacacuuuccgggucugcucaacaugucgaagagugcagcuguuacccuagauaucccggaguucggugcgugugucgcgacaacuggaagggcuccaauagaccuauuguggauaucaacgucaaagacuacagcauugugucuuccuacguuugcagcggccuggugggggacacaccccggaagaaugauucuuucagcuccucucacugucucgacccgaacaaugaagagggaggccauggggucaaaggaugggccuuugaugacggcaacgauguguggauggggcgcaccaucagcgaaaagcugagauccggauaugagaccuucaaaguuaucgagggcuggagcaagccuaauucuaaacugcagauuaaccgccaggugaucgucgaacggggcaauagauccggguacagcggaaucuuuucuguggagggcaaguccugcauuaaccgguguuucuaugucgaacucauuagagggcgcaaggaggaaacggaggugugguggacaagcaauuccaucguuguguuuugcggaaccucuggcaccuacgggacaggcagcuggcccgacggagcugauauuaaccugaugccuaucuga

SEQ ID NO: 199049 - RNA, 1410 nt, Artificial Sequence; identical to SEQ ID NO: 197249
  derived and/or modified sequence opt5 from neuraminidase__InfluenzaA__ABU92908

SEQ ID NO: 199050 - RNA, 1410 nt, Artificial Sequence; identical to SEQ ID NO: 197249
  derived and/or modified sequence opt5 from neuraminidase__InfluenzaA__ABU92909

SEQ ID NO: 199051 - RNA, 1410 nt, Artificial Sequence
  derived and/or modified sequence opt5 from neuraminidase__InfluenzaA__ABU92910
augaaccccaaucagaagaucauuaccaucggcagcgugucccugacaauugccacgaucugcuuccucacccaaauugcuauccugaucacaaccgucacacuucacuuuaaacaguacgaguguaacucuccuccgaauaaccagguuaugcugugcgaacccaccauuaucgagagaaauauuacagaaaucguguaucucaccaacacgaccauugagaaggaaaucuguccuaaacuggccgaguaccggaauuggagcaagccccagugcaacauuacaggguucgcgccuuuuuccaaagacaauucuauccgccuuagcgcuggaggcgauaucugggugaccagagagcccuaugucuccugugacccugauaagugcuaccaauucgcccuggggcagggaacaacccucaacaauggccauucuaacgacacggugcacgaucggacaccguaucgcacccugcugaugaaugaacucgggguucccuuucaucugggaacaaaacagguguguauugccuggagcuccagcucuugccacgacggcaaggcuuggcuucaugucugugugaccggcgaugacaagaacgccaccgcuuccuucaucuacaaugggagacugguugauagcauuggaucuugguccaaaaagauccuccggacacaggagagcgaaugcguguguauuaacggcacgugcaccgucgugaugacagacgggucugccuccggaaaagcggauaccaagauccuguuuaucgaggagggcaagauugugcacacaagccuucuguccgggucugcccaacacgucgaagagugcagcuguuauccucgcuaccccggaguuagaugcgugugucgggacaacuggaaaggcuccaaucgcccuaucguggauauuaacgucagagacuacagcaucgugucuuccuauguuugcagcggccucgugggggacacgccccggaagaaugauucuagcuccucuagccauugucuggacccgaacaaugaagagggaggccacggggucaaaggaugggcuuucgaugacggcaacgauguguggauggggcgcaccauuuccgaaaagcugagaagcggauacgagacauuuaaaguuaucgagggcuggucuaagccuaauuccaaacuccagaucaaccgccaggugauugucgacaagggcaaucggagcggguauucuggaaucuucuccguggaaggcaagagcugcauuaacagauguuuuuacgucgagcugauccgggggagaaaucaggaaaccgaggugcuuuggaccuccaacucuauuguuguguucugcggaacaagcggcaccuaugggacaggcuccuggcccgauggagccgacaucaaucugaugccuauuuga

SEQ ID NO: 199052 - RNA, 1410 nt, Artificial Sequence
  derived and/or modified sequence opt5 from neuraminidase__InfluenzaA__ABU92911
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacaggccgaguaccggaauuggagcaagccccaaugcaacaucacaggguucgcgccuuuuuccaaagacaauucuauucgccugagcgcuggaggcgauaucugggucaccagagagcccuauguguccugugacccugauaagugcuaccaguucgcccuugggcagggaacaacccugaacaauggccauucuaacgacacgguucacgaucggacaccguaucgcacccuccugaugaaugaacugggggugcccuuucaucucggaacaaagcaggucuguaucgccuggagcuccagcucuugccacgacggcaaggcuuggcugcauguguguguuaccggcgaugacaaaaacgccaccgcuuccuucauuuacaaugggagacuuguggauagcaucggaucuugguccaaaaagauucugcggacacaagagagcgaaugcgucuguaucaacggcacgugcaccguggugaugacagacgggucugccuccggaaaagcggauaccaagauucucuuuaucaaggagggcaaaaucguccacacaagccugcuuuccgggucugcccagcacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccuggucggggacacccccagaaagaaugauucuagcuccucuagccauugucucgacccgaacaaugaggaaggaggccacggggugaaaggaugggcuuucgaugacggcaacgauguuuggauggggcggacgaucuccgagaagcugcgcagcggauacgaaacauuuaaagugauugagggcuggucuaagccuaauuccaagcugcagaucaacagacaggucaucguggaccgggauaaucgcagcggcuauucugggauuuucuccgucgagggaaaaagcugcaucaacagauguuuuuacguggaacucauucggggcagaaaucaagagaccgaaguucuguggaccuccaacucuaucguggucuucugcgggacaagcggaaccuauggcacaggguccuggcccgacggcgccgauauuaaucuuaugccuaucuga

SEQ ID NO: 199053 - RNA, 1410 nt, Artificial Sequence
  derived and/or modified sequence opt5 from neuraminidase__InfluenzaA__ABU92913
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucaacggcacgugcaccguggugaugacagacgggucugccuccggaaaagcggauaccaagauucuguuuaucaaggagggcaaaaucguccacacaagccuucuguccgggucugcccaacacguugaggaaugcagcuguuauccucgcuaccccggagugagaugcgugugucgggacaacuggaagggcuccaaucgcccuauugucgauaucaacgugaaagacuacagcauuguuucuuccuaugugugcagcggccucgucggggacacccccagaaagaaugauucuagcuccucuagccauugucuggacccgaacaaugaggaaggaggccacggggugaaaggaugggcuuucgaugacggcaacgauguuuggauggggcggacgaucuccgagaagcugcgcagcggauacgaaacauuuaaagugauugagggcuggucuaagccuaauuccaagcuccagaucaacagacaggucaucguggaccgggauaaucgcagcggcuauucugggauuuucuccgucgagggaaaaagcugcaucaacagauguuuuuacguggaacugauucggggcagaaaucaggagaccgaaguucuuuggaccuccaacucuaucguggucuucugcgggacaagcggaaccuauggcacaggguccuggcccgacggcgccgauauuaaucugaugccuaucuga

SEQ ID NO: 199054 - RNA, 1413 nt, Artificial Sequence
  derived and/or modified sequence opt5 from neuraminidase__InfluenzaA__ABV29560
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaauaccacgaucuggacauccggaucuagcauuuccuucugcggcgucgauagcgacaccgccaacuggucuuggccugauggggcugagcuccccuuuaccaucgacaaauga

SEQ ID NO: 199055 - RNA, 1413 nt, Artificial Sequence; identical to SEQ ID NO: 199054
  derived and/or modified sequence opt5 from neuraminidase__InfluenzaA__ABV29571

SEQ ID NO: 199056 - RNA, 1413 nt, Artificial Sequence; identical to SEQ ID NO: 199054
  derived and/or modified sequence opt5 from neuraminidase__InfluenzaA__ABV29582

SEQ ID NO: 199057 - RNA, 1413 nt, Artificial Sequence; identical to SEQ ID NO: 199054
  derived and/or modified sequence opt5 from neuraminidase__InfluenzaA__ABV29615

SEQ ID NO: 199058 - RNA, 1413 nt, Artificial Sequence
  derived and/or modified sequence opt5 from neuraminidase__InfluenzaA__ABV29637
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacgggacagcuagcuacaaaaucuucaagauugaaaagggaaaagucaccaaguccaucgagcugaaugccccuaacuuucacuaugaagaguguucuugcuacccggacaccggcacagugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacgguggauggcgcugacggggucaaaggauucuccuacaaguauggcaaugggguguggaucggacgcaccaaaagcaacaagcugagaaagggcuuugagaugauuugggaccccaauggguggacagauaccgacucugauuucuccguuaaacaagacguggucgccaucagcgauugguccggcuacucuggauccuuugugcagcauccggaacucacaggccuggacugcauucggccuuguuucuggguugagcuugugcgcgggcugcccagagaaaacaccacgaucuggacauccggaucuagcaucuccuucugcggcgucgauagcgacaccgcgaauuggucuuggccugauggggccgagcuccccuuuaccauugacaaguga

SEQ ID NO: 199059 - RNA, 1413 nt, Artificial Sequence; identical to SEQ ID NO: 199054
  derived and/or modified sequence opt5 from neuraminidase__InfluenzaA__ABV29648

SEQ ID NO: 199060 - RNA, 1413 nt, Artificial Sequence; identical to SEQ ID NO: 199054
  derived and/or modified sequence opt5 from neuraminidase__InfluenzaA__ABV29659

SEQ ID NO: 199061 - RNA, 1413 nt, Artificial Sequence; identical to SEQ ID NO: 199054
  derived and/or modified sequence opt5 from neuraminidase__InfluenzaA__ABV29670

SEQ ID NO: 199062 - RNA, 1413 nt, Artificial Sequence
  derived and/or modified sequence opt5 from neuraminidase__InfluenzaA__ABV29681
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaauaccacgaucuggacauccggaucuagcauuuccuucugcggcaucgauagcgacaccgccaacuggucuuggccugauggggcugagcuccccuuuaccauugacaaauga

SEQ ID NO: 199063 - RNA, 1413 nt, Artificial Sequence; identical to SEQ ID NO: 199054
  derived and/or modified sequence opt5 from neuraminidase__InfluenzaA__ABV29692

SEQ ID NO: 199064 - RNA, 1413 nt, Artificial Sequence; identical to SEQ ID NO: 199054
  derived and/or modified sequence opt5 from neuraminidase__InfluenzaA__ABV29703

SEQ ID NO: 199065 - RNA, 1410 nt, Artificial Sequence
  derived and/or modified sequence opt5 from neuraminidase__InfluenzaA__ABV29714
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcgaggccgacacaaagauccucuuuauugaagaggggaaaaucguccauaccuccacacugucuggaagcgcgcaacacguugaagagugcuccugcuauccuagauaccccggcgugcggugugugugccgcgauaacuggaaggggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgagaaaucuagacucggcuaugaaacauuuaagguuauugaggggugguccaacccuaaaagcaagcugcagaucaaucgccaggugauugucgaucggggaaacagaucuggcuacuccggcaucuucagcguggaagggaaauccuguauuaaucggugcuuuuaugucgagcugaucagaggacgcaaggaagagaccgaggugcucuggaccucuaacagcauuguuguguucuguggcacauccgggaccuacggaacaggcucuuggcccgacggggcugauaucaaucugaugccuaucuga

SEQ ID NO: 199066 - RNA, 1410 nt, Artificial Sequence
  derived and/or modified sequence opt5 from neuraminidase__InfluenzaA__ABV29725
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccaggggaugcuuugugaacccaccaucauugagagaaauaucacagaaauuguuuaucugaccaacacgaccaucgagaaggaaauuugcccuaaacucgcugaguaccggaauugguccaagccccagugugacaucacaggauucgccccuuuuucuaaagauaacagcauucgccuguccgcgggcggggacaucugggugaccagagagcccuaugugucuugcgauccugacaaguguuaccaauucgcucuuggacagggcacaacccugaauaacguccauagcaaugauacggugcgggaccgcacaccguauagaacccuccugaugaacgaacuggggguucccuuucaccucggaacaaaacaggugugcaucgccugguccucuagcuccugucaugauggcaaggccuggcugcacgucugcauuaccggcgacgauaagaaugcuaccgccagcuucaucuacaacgggcggcuuguggacucuauuguuuccuggagcaaagagauccugcgcacacaggaaucugagugugugugcauuaauggaacguguaccgucgugaugacagauggcuccgcuagcgggaaggccgacaccaaaauccucuuuaucgaggaaggaaagauugugcauacauccacccugucuggcagcgcgcaacacgucgaggaaugcuccugcuucccuagauaucccgggguucggugugugugccgcgauaacuggaagggaagcaacagaccuaucguggacauuaauaucaaagaccacucuauugucuccagcuacguguguucuggccuuguuggcgauacgccccggaagaacgacagcuccucuagcucccauugccuggauccgaauaacgaggaagggggacacggcgugaaagggugggccuuugacgauggaaaugacgucuggaugggccgcacaaucagcgagaagucuagacucggguacgagaccuucaaagugaucgaaggaugguccaacccuaagagcaaacugcagauuaaucggcagguuaucguggaucgcggcaacagaucuggcuauuccgggauuuuuagcgucgagggaaaguccuguaucaaucggugcuucuacguggaacugauuagaggccgcaaggaggaaaccgagguccucuggacaucuaacagcaucgugguuuucugugggaccuccggaacauauggcacggggucuuggcccgacggcgcugauauuaaucugaugccuaucuga

SEQ ID NO: 199067 - RNA, 1413 nt, Artificial Sequence
  derived and/or modified sequence opt5 from neuraminidase__InfluenzaA__ABV29736
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguugugaccggaaaagacaagacaucugugacccuggccggcaauagcucccuuuguagcauuucugggugggcgaucuacacgaaagauaacuccauucggaucggaagcaagggcgacgucuucgugauucgcgagccuuuuaucucuugcucccaucuggaguguagaaccuucuuucucacacaaggcgcucugcuuaaugauaaacacagcaacgggaccguuaaggaccggucuccguaucgcgcccugauguccugcccccucggagaagccccuagccccuacaauuccaaguucgagucuguggcuuggagcgccuccgcuugucaugauggcaugggguggcugacaaucggaauuagcggcccugacaacggggccgucgcggugcugaaauauaacggaaucauuaccgaaacgaucaagucuuggaaaaagcggauucucagaacacaggaguccgagugcguuugugugaauggcagcugcuuuaccaucaugacagauggccccucugacggggccgcuagcuacaaaaucuucaagauugaaaagggaaaagucaccaaguccaucgagcugaacgccccuaauuuucacuaugaagaguguucuugcuacccggauaccggcacagugaugugugugugccgcgacaacuggcacgggagcaauagacccugggucuccuucaaccagaaucuugauuaccagauuggauauaucugcagcggcguuuuuggggacaacccucggcccaaagauggaaagggcucuuguaauccugugacgguggacggcgcugacggggucaaaggauucuccuacaaguauggcaacgggguguggauuggacgcaccaaaagcaauaagcugagaaagggcuuugagaugaucugggaucccaacggguggacagacaccgauaaugacuucucuguuaaacaagauguggucgccauuacagacugguccggcuacagcggauccuuugugcagcauccggaacucaccggccuggauugcauccggccuuguuucuggguugagcuugugcgcgggcugcccagagaaaacacgacaaucuggaccucuggaagcuccauuucuuucugcggcgucgacagcgauaccgcgaauugguccuggccugacggggccgagcuccccuuuacaaucgauaaguga

SEQ ID NO: 199068 - RNA, 1413 nt, Artificial Sequence
  derived and/or modified sequence opt5 from neuraminidase__InfluenzaA__ABV29747
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguucgccaagacguggucgcgauuaccgauugguccggcuacucuggauccuuugugcagcauccggaacucacaggccuggacugcaucagaccuuguuucuggguugagcuugugcgggggcugccccgcgaaaauaccacgaucuggacauccggaucuagcauuuccuucugcggcgucgauagcgacaccgccaacuggucuuggccugauggggcugagcuccccuuuaccaucgacaaguga

SEQ ID NO: 199069 - RNA, 1413 nt, Artificial Sequence; identical to SEQ ID NO: 199054
  derived and/or modified sequence opt5 from neuraminidase__InfluenzaA__ABV29769

SEQ ID NO: 199070 - RNA, 1413 nt, Artificial Sequence
  derived and/or modified sequence opt5 from neuraminidase__InfluenzaA__ABV29780
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguugugaccggaaaagacaagacaucugugacccuggccggcaauagcucccuuuguagcauuucugggugggcgaucuacacgaaagauaacuccauucggaucggaagcaagggcgacgucuucgugauucgcgagccuuuuaucucuugcucccaucuggaguguagaaccuucuuucucacacaaggcgcucugcuuaaugauaaacacagcaacgggaccguuaaggaccggucuccguaucgcgcccugauguccugcccccucggagaagccccuagccccuacaauuccaaguucgagucuguggcuuggagcgccuccgcuugucaugauggcaugggguggcugacaaucggaauuagcggcccugacaacggggccgucgcggugcugaaauauaacggaaucauuaccgaaacgaucaagucuuggaaaaagcggauucucagaacacaggaguccgagugcguuugugugaauggcagcugcuuuaccaucaugacagauggccccucugacggggccgcuagcuacaaaaucuucaagauugaaaagggaaaagucaccaaguccaucgagcugaacgccccuaauuuucacuaugaagaguguucuugcuacccggauaccggcacagugaugugugugugccgcgacaacuggcacgggagcaauagacccugggucuccuucaaccagaaucuugauuaccagauuggauauaucugcagcggcguuuuuggggacaacccucggcccaaagauggaaagggcucuuguaauccugugacgguggacggcgcugacggggucaaaggauucuccuacaaguauggcaacgggguguggauuggacgcaccaaaagcucuaagcugagaaagggcuuugagaugaucugggaucccaauggguggacagacaccgauaacgacuucuccguuaaacaagauguggucgccauuacagacuggagcggcuacuccggaucuuuugugcagcauccggaacucaccggccuggauugcauccggccuuguuucuggguugagcuugugcgcgggcugcccagagaaaauacgacaaucuggaccagcggauccucuauuagcuucugcggcgucgacuccgauaccgcgaacuggagcuggccugacggggccgagcuccccuuuacaaucgauaaguga

SEQ ID NO: 199071 - RNA, 1413 nt, Artificial Sequence; identical to SEQ ID NO: 199054
  derived and/or modified sequence opt5 from neuraminidase__InfluenzaA__ABV29791

SEQ ID NO: 199072 - RNA, 1413 nt, Artificial Sequence; identical to SEQ ID NO: 199054
  derived and/or modified sequence opt5 from neuraminidase__InfluenzaA__ABV29802

SEQ ID NO: 199073 - RNA, 1410 nt, Artificial Sequence; identical to SEQ ID NO: 198908
  derived and/or modified sequence opt5 from neuraminidase__InfluenzaA__ABV29824

SEQ ID NO: 199074 - RNA, 1413 nt, Artificial Sequence; identical to SEQ ID NO: 199054
  derived and/or modified sequence opt5 from neuraminidase__InfluenzaA__ABV29835

SEQ ID NO: 199075 - RNA, 1413 nt, Artificial Sequence
  derived and/or modified sequence opt5 from neuraminidase__InfluenzaA__ABV29846
augaaccccaaucagaagaucauuaccaucggcagcauuuccaucgccauugggaucaucucucugaugcuccaaauuggaaacaucauuagcaucugggcuucccacucuauucagaucggcagccagaaucauacagggauuugcaaccagagaaucaucacguacgaaaauuccaccugggugaaccacacauaugucaauauuaacaauaccaacguuguggccggaaaagacaagacaucugugacccuggcgggcaauagcucccuuuguagcaucucugggugggcuauuuacacaaaagauaacuccauccggauuggaagcaagggcgacgucuucgugauccgcgagccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagagaauccuccggacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgcgauaauuggcacgggagcaacagacccugggucuccuucaaucagaaccuugacuaccagguuggauauaucugcagcggcguguuuggggauaauccucggcccaaagacggaaagggcucuuguaacccuaugaccguggauggcgccgacggggucaaaggauucuccuacaaguauggcaaugggguguggauuggacgcacaaaaagcaacaagcugagaaagggcuuugagaugaucugggaccccaauggguggacggauaccgacucugauuucuccguuaaacaagacguggucgcgauuacagauuggagcggcuacuccggaucuuuugugcagcauccggaacucaccggccuggacugcauccggccuuguuucuggguugagcuugugcgcgggcugcccagagaaaacacaaccaucuggacgagcggauccucuauuagcuucugcggcgucgauuccgacacagccaauuggagcuggccugauggggcugagcuccccuuuaccaucgacaaguga

SEQ ID NO: 199076 - RNA, 1413 nt, Artificial Sequence
  derived and/or modified sequence opt5 from neuraminidase__InfluenzaA__ABV29879
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucauuauccgcgaaccuuuuaucuccugcagccaucuggaguguagaacguucuuucucacccaaggcgcccugcuuaacgauaaacacucuaaugggacagugaaggaccgguccccguaucgcgcccugaugagcugcccccucggagaagcuccuucccccuacaacucuaaguucgagagcguugccugguccgcuagcgccugucaugauggcaugggguggcugaccauuggaaucucuggcccugacaauggggcgguggccguccugaaauauaacggaauuaucacagaaaccauuaaguccuggaaaaagagaauccuccggacgcaggagagcgagugcguguguguuaacggcucuugcuuuacaaucaugaccgauggccccagcaauggggcugccuccuacaaaauuuucaagaucgaaaagggaaaagugacaaagucuauugagcugaacgcuccuaauuuucacuaugaagaguguagcugcuacccggacaccggcaccgucaugugugugugccgcgauaacuggcacggguccaauagacccugggugagcuucaaccagaaucuugacuaccagaucggauauauuugcucuggcgucuuuggggauaacccucggcccaaagacggaaagggcuccuguaauccuguuacaguggauggcgccgacggggugaaaggauucagcuacaaguauggcaacggggucuggaucggacgcacgaaaucuaauagacugcggaagggcuuugagaugauuugggaccccaacggguggaccgauacagacuccgauuucagcgugaagcaagacguuguggcgaucaccgauugguccggcuacucuggauccuuuguccagcauccggaacucacaggccuggacugcauccgcccuuguuucuggguggagcuuguuagagggcugccccgggaaaauaccacgauuuggacauccggaucuagcaucuccuucugcggcguggauagcgacaccgccaacuggucuuggccugauggggcugagcuccccuuuaccauugacaaauga

SEQ ID NO: 199077 - RNA, 1413 nt, Artificial Sequence; identical to SEQ ID NO: 199054
  derived and/or modified sequence opt5 from neuraminidase__InfluenzaA__ABV29890

SEQ ID NO: 199078 - RNA, 1410 nt, Artificial Sequence; identical to SEQ ID NO: 198908
  derived and/or modified sequence opt5 from neuraminidase__InfluenzaA__ABV29901

SEQ ID NO: 199079 - RNA, 1410 nt, Artificial Sequence
  derived and/or modified sequence opt5 from neuraminidase__InfluenzaA__ABV29912
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccagcagcuccugucacgauggaaaagccuggcugcaugugugcguuacaggcgacgauaagaaugcuaccgccagcuucaucuacaacggcagacuuguggacucuauugucuccuggagcaaagauauccugcggacccaggagucugaauguauuugcaucaaugggacauguacgguggugaugaccgacggauccgcuagcggcaaggccgauacaaaaauccucuuuauugaggaggggaagaucguccacaccuccacacugucuggaagcgcgcaacacguugaagagugcuccugcuauccucgcuaccccggcgugagaugugugugccgggacaacuggaaggggagcaaccgcccuauugucgacaucaauauuaaagauuacucuaucguguccagcuauguuuguucuggacuugugggcgacacccccagaaagaacgauagcuccucuagcucccauugccuggacccgaauaacgaagagggcgggcacggagucaaaggcugggccuucgaugacgggaaugauguguggaugggacggacgaucagcgaaaagcuccgccugggcuacgagacauuuaaaguuauugagggguggucuaacccuaauuccaagcugcagaucaacagacaggugauugucgacaaaggaaaucggagcggcuauucuggcaucuucuccguggaagggaagucuuguauuaaccgcugcuuuuacgucgagcucaucagaggacggaaggaagagaccgaagugcuguggaccuccaauucuauuguuguguucuguggcacaagcgggaccuauggaacaggcuccuggcccgauggggcugacaucaaccuuaugccuaucuga

SEQ ID NO: 199080 - RNA, 1413 nt, Artificial Sequence
  derived and/or modified sequence opt5 from neuraminidase__InfluenzaA__ABV29923
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacaagcugagaaagggcuuugagaugauuugggaccccaauggguggaccgauacagacucugauuucuccguuaaacaagacguggucgcgaucaccgauuggagcggcuacuccggaucuuuugugcagcauccggaacucacaggccuggacugcauucggccuuguuucuggguugagcuugugcgcgggcugcccagagaaaacgccaccaucuggacgagcggauccucuaucagcuucugcggcgucgauuccgacacagcuaauuggagcuggccugauggggccgagcuccccuuuaccauugacaaguga

SEQ ID NO: 199081 - RNA, 1410 nt, Artificial Sequence
  derived and/or modified sequence opt5 from neuraminidase__InfluenzaA__ABV29934
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaaccggcuacucuggcaucuucuccguggaggggaagucuuguauuaaucggugcuuuuaugucgaacugaucagaggacgcaaggaggaaaccgaggugcucuggacauccaacucuauuguuguguucuguggcaccagcgggacauacggaacgggcuccuggcccgacggggcugauaucaaucugaugccuaucuga

SEQ ID NO: 199082 - RNA, 1413 nt, Artificial Sequence; identical to SEQ ID NO: 199067
  derived and/or modified sequence opt5 from neuraminidase__InfluenzaA__ABV29945

SEQ ID NO: 199083 - RNA, 1413 nt, Artificial Sequence
  derived and/or modified sequence opt5 from neuraminidase__InfluenzaA__ABV29956
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaagggaaucauuacagaaaccaucaaauccuggaagaaacggauucucagaacgcaggagagcgagugcguuugugugaacggcucuugcuuuacaaucaugaccgauggccccagcaacggggcugccuccuacaagaucuucaagauugaaaaaggaaaggucacaaaaucuaucgagcugaaugcuccuaacuuucacuaugaagaguguagcugcuacccggacaccggcaccgugaugugugugugccgcgauaauuggcacggguccaacagacccugggucagcuucaaucagaaccuugacuaccagauuggauauaucugcucuggcguuuuuggggauaauccucggcccaaggacggaaaaggcuccuguaacccugugacaguggauggcgccgacggggucaagggauucagcuacaaauauggcaaugggguguggauuggacgcacgaagucuaacagacugcggaagggcuuugagaugaucugggaccccaauggguggaccgauacagacuccgauuucagcguuaaacaagacguggucgcgauuaccgauugguccggcuacucuggauccuuugugcagcauccggaacucacaggccuggacugcauccgcccuuguuucuggguugagcuugugagagggcugccccgggaaaacaccacgaucuggacauccggaucuagcauuuccuucugcggcgucgauagcgacaccgccaauuggucuuggccugauggggcugagcuccccuuuaccaucgacaaguga

SEQ ID NO: 199084 - RNA, 1413 nt, Artificial Sequence
  derived and/or modified sequence opt5 from neuraminidase__InfluenzaA__ABV29989
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugaugcgcgaaccuuuuauuuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaaucucuggcccugacaauggggcggucgccgugcugaaauauaacggaauuaucacagaaaccauuaaguccuggaaaaagagaauccuccggacgcaggagagcgagugcguuugugugaacggcucuugcuuuacaauuaugaccgauggccccagcaauggggcugccuccuacaaaaucuucaagaucgaaaagggaaaagucacaaagucuauugagcugaacgcuccuaauuuucacuaugaagaguguagcugcuacccggacaccggcaccgugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacaguggauggcgccgacggggucaaaggauucagcuacaaguauggcaacgggguguggaucggacgcacgaaaucuaauagacugcggaagggcuuugagaugauuugggaccccaacggguggaccgauacagacuccgauuucagcguuaagcaagacguggucgcgaucaccgauugguccggcuacucuggauccuuugugcagcauccggaacucacaggccuggacugcauucgcccuuguuucuggguugagcuugugagagggcugccccgggaaaauaccacgaucuggacauccggaucuagcaucuccuucugcggcgucgauagcgacaccgccaacuggucuuggccugauggggcugagcuccccuuuaccauugacaaauga

SEQ ID NO: 199085 - RNA, 1413 nt, Artificial Sequence; identical to SEQ ID NO: 199054
  derived and/or modified sequence opt5 from neuraminidase__InfluenzaA__ABV30000

SEQ ID NO: 199086 - RNA, 1413 nt, Artificial Sequence; identical to SEQ ID NO: 199054
  derived and/or modified sequence opt5 from neuraminidase__InfluenzaA__ABV30011

SEQ ID NO: 199087 - RNA, 1413 nt, Artificial Sequence; identical to SEQ ID NO: 199054
  derived and/or modified sequence opt5 from neuraminidase__InfluenzaA__ABV30022

SEQ ID NO: 199088 - RNA, 1413 nt, Artificial Sequence
  derived and/or modified sequence opt5 from neuraminidase__InfluenzaA__ABV30044
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucuggcacacuggcggggaauagcucccuuuguagcauuucuggaugggcuaucuacaccaaagauaacuccauucggaucggcagcaagggcgacguguucgucauucgcgagccuuuuaucucuugcucccaucuggaguguagaacguucuuucucacccaaggggcccugcuuaaugauaaacacagcaacggaacagugaaggaccggucuccguaucgcgcccugauguccugcccccucggcgaagcuccuagccccuacaauuccaaguucgagucuguugccuggagcgcuuccgccugucaugaugggaugggauggcugaccaucggcauuagcgggccugacaacggagcgguggccguccugaaauauaacggcaucauuacagaaaccaucaagucuuggaaaaagcggauucucagaacgcaggaguccgagugcguguguguuaauggcagcugcuuuacaaucaugaccgaugggcccucuaacggagcugccagcuacaaaaucuucaagauugaaaagggcaaagugacaaaguccaucgagcugaaugcuccuaacuuucacuaugaagaguguucuugcuacccggacaccgggaccgucaugugugugugccgcgauaauuggcacggaagcaacagacccuggguguccuucaaucagaaccuugacuaccaggucggcuauauuugcagcgggguuuuuggagauaauccucggcccaaagacggcaagggcucuuguaacccuaugacaguggauggggccgacggagugaaaggcuucuccuacaaguaugggaauggagucuggaucggccgcacgaaaagcaacaagcugagaaagggguuugagaugauuugggaccccaauggcuggaccgauacagacucugauuucuccgugaaacaagacguuguggcgaucaccgauuggagcggauacuccggcucuuuuguccagcauccggaacucacagggcuggacugcauucggccuuguuucuggguggagcuuguucgcggacugcccagagaaaacaccacgaucuggacaagcggcuccucuaucagcuucugcgggguggauuccgacaccgccaauuggagcuggccugauggagcugagcuccccuuuaccauugacaaguga

SEQ ID NO: 199089 - RNA, 1413 nt, Artificial Sequence
  derived and/or modified sequence opt5 from neuraminidase__InfluenzaA__ABV30055
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacaagcugagaaagggcuuugagaugauuugggaccccaauggguggaccgauacagacucugauuucuccguuaaacaagacguggucgcgaucaccgauuggagcggcuacuccggaucuuuugugcagcauccggaacucacaggccuggacugcauucggccuuguuucuggguugagcuugugcgcgggcugcccagagaaaacaccacgaucuggacaagcggauccucuaucagcuucugcggcgucgauuccgacaccgccaauuggagcuggccugauggggcugagcuccccuuuaccauugacaaguga

SEQ ID NO: 199090 - RNA, 1410 nt, Artificial Sequence
  derived and/or modified sequence opt5 from neuraminidase__InfluenzaA__ABV30077
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaaugggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggacaucuaacagcaucguuguguucuguggcaccuccgggacauacggaacgggcucuuggcccgacggggcugauauuaaucugaugccuaucuga

SEQ ID NO: 199091 - RNA, 1413 nt, Artificial Sequence; identical to SEQ ID NO: 199054
  derived and/or modified sequence opt5 from neuraminidase__InfluenzaA__ABV30088

SEQ ID NO: 199092 - RNA, 1413 nt, Artificial Sequence; identical to SEQ ID NO: 199054
  derived and/or modified sequence opt5 from neuraminidase__InfluenzaA__ABV30099

SEQ ID NO: 199093 - RNA, 1413 nt, Artificial Sequence
  derived and/or modified sequence opt5 from neuraminidase__InfluenzaA__ABV30110
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgagccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacaggcaccaucaaguccuggaaaaagcggauucucagaacgcaggaaagcgagugcguuugugugaacggcucuugcuuuacaaucaugaccgaugggcccagcaauggagcugccuccuacaaaaucuucaagauugagaagggcaaagucacaaagucuaucgaacugaacgcuccuaauuuucacuaugaggaauguagcugcuacccggacaccgggaccgugaugugugugugccgcgauaacuggcacggauccaauagacccugggucagcuucaaccagaaucuugacuaccagauuggcuauaucugcucugggguuuuuggagauaacccucggcccaaagacggcaagggcuccuguaauccugugacaguggauggggccgacggagucaaaggcuucagcuacaaguaugggaacggaguguggauuggccgcacgaaaucuaauagacugcggaagggguuugagaugaucugggaccccaacggcuggaccgauacagacuccgauuucagcguuaagcaagacguggucgcgauuaccgauugguccggauacucuggcagcuuugugcagcauccggagcucacagggcuggacugcauccgcccuuguuucuggguugaacuugugagaggacugccccgggagaauaccacgaucuggacauccggcucuagcauuuccuucugcggggucgauagcgacaccgccaacuggucuuggccugauggagcugaacuccccuuuaccaucgacaaauga

SEQ ID NO: 199094 - RNA, 1413 nt, Artificial Sequence; identical to SEQ ID NO: 199054
  derived and/or modified sequence opt5 from neuraminidase__InfluenzaA__ABV30132

SEQ ID NO: 199095 - RNA, 1413 nt, Artificial Sequence
  derived and/or modified sequence opt5 from neuraminidase__InfluenzaA__ABV30143
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccaacacagauucugacuucuccguuaagcaagauguggucgcgauuaccgacuggagcggcuacuccggaucuuuugugcagcauccggaacucacaggccuggauugcauccgcccuuguuucuggguugagcuugugagagggcugccccgggaaaauaccacgaucuggacaagcggauccucuauuagcuucugcggcgucgacuccgauaccgccaacuggagcuggccugacggggcugagcuccccuuuaccaucgauaaauga

SEQ ID NO: 199096 - RNA, 1413 nt, Artificial Sequence; identical to SEQ ID NO: 199080
  derived and/or modified sequence opt5 from neuraminidase__InfluenzaA__ABV30154

SEQ ID NO: 199097 - RNA, 1413 nt, Artificial Sequence
  derived and/or modified sequence opt5 from neuraminidase__InfluenzaA__ABV30165
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaaccuuucccuguguagcauuucugggugggcuaucuacaccaaagauaauuccauucggaucggaagcaagggcgacgucuucgugauucgcgagccuuuuaucucuugcucccaucucgaguguagaacguucuuucugacccaaggcgcccuucugaacgauaaacacagcaaugggacaguuaaggaccggucuccguaucgcgcccucauguccugcccccugggagaagcuccuagccccuacaacuccaaguucgagucuguggccuggagcgcuuccgccugucaugauggcaugggguggcugaccaucggaauuagcggcccugacaauggggcggucgccgugcucaaauauaacggaaucauuacagaaaccaucaagucuuggaaaaagcggauucugagaacgcaggaguccgagugcguuugugugaacggcagcugcuuuacaaucaugaccgauggccccucuaauggggcugccagcuacaaaaucuucaagauugaaaagggaaaagucacaaaguccaucgagcuuaacgcuccuaauuuucacuaugaagaguguucuugcuacccggacaccggcaccgugaugugugugugccgcgauaacuggcacgggagcaauagacccugggucuccuucaaccagaaucuggacuaccagauuggauauaucugcagcggcguuuuuggggauaacccucggcccaaagacggaaagggcucuuguaauccugugacaguggauggcgccgacggggucaaaggauucuccuacaaguauggcaacgggguguggauuggacgcacgaaaagcaauagacuccggaagggcuuugagaugaucugggaccccaacggguggaccgauacagacucugauuucuccguuaagcaagacguggucgcgauuaccgauuggagcggcuacuccggaucuuuugugcagcauccggaacugacaggccuugacugcauccgcccuuguuucuggguugagcuggugagagggcucccccgggaaaauaccacgaucuggacaagcggauccucuauuagcuucugcggcgucgauuccgacaccgccaacuggagcuggccugauggggcugagcugcccuuuaccaucgacaaauga

SEQ ID NO: 199098 - RNA, 1413 nt, Artificial Sequence; identical to SEQ ID NO: 199054
  derived and/or modified sequence opt5 from neuraminidase__InfluenzaA__ABV30187

SEQ ID NO: 199099 - RNA, 1413 nt, Artificial Sequence; identical to SEQ ID NO: 199054
  derived and/or modified sequence opt5 from neuraminidase__InfluenzaA__ABV30198

SEQ ID NO: 199100 - RNA, 1410 nt, Artificial Sequence; identical to SEQ ID NO: 198908
  derived and/or modified sequence opt5 from neuraminidase__InfluenzaA__ABV30209

SEQ ID NO: 199101 - RNA, 1410 nt, Artificial Sequence; identical to SEQ ID NO: 199090
  derived and/or modified sequence opt5 from neuraminidase__InfluenzaA__ABV30220

SEQ ID NO: 199102 - RNA, 1410 nt, Artificial Sequence; identical to SEQ ID NO: 199090
  derived and/or modified sequence opt5 from neuraminidase__InfluenzaA__ABV30231

SEQ ID NO: 199103 - RNA, 1410 nt, Artificial Sequence
  derived and/or modified sequence opt5 from neuraminidase__InfluenzaA__ABV30264
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaagugguguaucugacaaauaccacgaucgagaaggaaauuugcccuaaacucgcugaguaccggaacuggucuaagccccagugugacaucaccggguucgccccuuuuagcaaagauaauuccauucgccugucugcgggaggcgacaucugggucacaagagagcccuaugugagcugcgauccugacaaguguuaccaauucgcucuugggcagggaaccacacugaacaauguucauuccaacgauaccgugcacgaccggacgccguaucgcacacuccugaugaaugaacugggcguccccuuucaucucgggaccaaacaggugugcaucgccuggucuagcuccagcugucacgauggaaaggccuggcugcauguuugcgugacaggcgacgauaagaacgcuaccgccucuuucauuuacaauggcagacuugucgacuccaucgugagcuggucuaaagagauucugcggacccaggaauccgagugugugugcaucaacgggacauguacggucguuaugaccgauggaagcgcuuccggcaaggccgacacaaaaauucucuuuaucgaggaagggaagaucgugcacaccucuacacugagcggauccgcgcaacacguggaggaaugcagcugcuauccucgcuaccccggcgucagaugugugugccgggauaauuggaaggggucuaaccgcccuauuguugacaucaacauuaaagacuacuccaucgugagcagauaugucuguucuggacuugugggcgauacgccccggaagaaugacagcuccucuagcucccauugccuggauccgaacaaugaggaaggcgggcacggaguuaaaggcugggccuucgacgaugggaacgacguguggaugggacgcaccauuagcgagaagucuagauccggcuacgagacauuuaaagucaucgaaggguggagcaauccuaacucuaagcuccagaucaaucgccaggugauugucgaucggggaaacagauccggcuauagcggcaucuucuccguggaggggaaaucuuguauuaaucggugcuuuuacguugaacugaucagaggacgcaaggaggaaaccgaggugcuguggaccagcaacuccauugucguguucuguggcacaucugggaccuauggaacaggcagcuggcccgacggggcugauaucaaucucaugccuauuuga

SEQ ID NO: 199104 - RNA, 1410 nt, Artificial Sequence
  derived and/or modified sequence opt5 from neuraminidase__InfluenzaA__ABV30275
augaaccccaaucagaagaucauuaccaucggcagcgugucccugacaauuucuacgaucugcuucuuuaugcaaaccgccauucucaucacaaccgucacacugcacuucaaacaguacgaguuuaacagcaccccuaauaaccagguuaugcuuugugaaccgacaaucauugagagaaauaucaccgaaauuguguaucugacgaacaccacaaucgagaaggaaauuugccccaaacucgcugaguaccggaauugguccaagccucagugugacaucaccggguucgcccccuuuucuaaagauaacagcauucgccuguccgcgggaggcgacaucugggugacaagagagccuuaugucucuugcgaucccgacaaguguuaccaauucgcucuugggcagggaaccacgcugaauaacgugcauagcaaugauacaguucgggaccgcaccccuuauagaacacuccugaugaacgaacugggcgugccguuucaccucgggaccaagcaggucugcaucgccugguccagcagcuccugucaugauggaaaagccuggcugcacgugugcauuaccggcgacgauaagaaugcuacagccagcuucaucuacaacggccggcuuguugacucuauuguguccuggagcaaagagauccugcgcacgcaggaaucugagugugucugcauuaaugggaccuguacaguggugaugaccgauggauccgcuagcggcaaggccgacacaaaaauccucuuuaucgaggaagggaagauuguccauaccuccacgcugucuggaagcgcgcaacacguugaggaaugcuccugcuaucccagauacccuggcgugcggugugugugccgcgauaacuggaaggggagcaacagacccaucgucgacauuaauaucaaagaccacucuauuguguccagcuacguuuguucuggacuugugggcgauacaccucggaagaacgacagcuccucuagcucccauugccuggaucccaauaacgaggaaggcgggcacggagucaaaggcugggccuucgacgaugggaaugacguguggaugggacgcaccaucagcgagaagucuagacucggcuaugagaccuuuaaaguuaucgaagggugguccaacccgaagucuaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaacagaggugcucuggaccucuaacagcaucguuguguucuguggcacauccgggacguacggaaccggcucuuggccugacggggcugauauuaaucugaugcccaucuga

SEQ ID NO: 199105 - RNA, 1413 nt, Artificial Sequence; identical to SEQ ID NO: 199095
  derived and/or modified sequence opt5 from neuraminidase__InfluenzaA__ABV30297

SEQ ID NO: 199106 - RNA, 1413 nt, Artificial Sequence
  derived and/or modified sequence opt5 from neuraminidase__InfluenzaA__ABV30308
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugucugaacggcucuugcuuuacaaucaugaccgauggccccagcaauggggcugccuccuacaaaaucuucaagauugaaaagggaaaagugacaaagucuaucgagcuuaacgcuccuaauuuucacuaugaagaguguagcugcuacccggacaccggcaccgucaugugugugugccgcgauaacuggcacggguccaauagacccugggugagcuucaaccagaaucuggacuaccagauuggauauaucugcucuggcgucuuuggggauaacccucggcccaaagacggaaagggcuccuguaauccuguuacaguggauggcgccgacggggugaaaggauucagcuacaaguauggcaacggggucuggauuggacgcacgaaaucuaauagacuccggaagggcuuugagaugaucugggaccccaacggguggaccgauacagacuccgauuucagcgugaagcaagacguuguggcgauuaccgauugguccggcuacucuggauccuuuguccagcauccggaacugacaggccuugacugcauccgcccuuguuucuggguggagcugguuagagggcucccccgggaaaauaccacgaucuggacauccggaucuagcauuuccuucugcggcguggauagcgacaccgccaacuggucuuggccugauggggcugagcugcccuuuaccaucgacaaauga

SEQ ID NO: 199107 - RNA, 1413 nt, Artificial Sequence
  derived and/or modified sequence opt5 from neuraminidase__InfluenzaA__ABV30319
augaaccccaaucagaagaucauuaccaucggcagcauuuccaucgccauugggaucaucucucugaugcuccaaauuggaaacaucgugagcauuugggcuucccacucuauccagacaggcagccagaaucauacggggauuugcaaccagagaaucauuaccuacgagaauagcacaugggucaaccacaccuauguuucuaucaauaacacaaaugugguggccggaaaagacaagaccagcgucacacuggcgggcaacuccagccuuuguucuaucuccgggugggcuauuuacaccaaagauaauagcauccggauuggaucuaagggcgacguguucguuauccgcgaaccuuuuauuuccugcagccaucuggaguguagaacguucuuucucacccaaggcgcccugcuuaacgauaaacacucuaaugggacagugaaggaccgguccccguaucgcgcccugaugagcugcccccucggagaagcuccuucccccuacaacucuaaguucgagagcgucgccugguccgcuagcgccugucaugauggcaugggguggcugaccaucggaaucucuggcccugacaauggggcgguggccguucugaaauauaacggaauuaucacagaaaccauuaaguccuggaaaaagagaauccuccggacgcaggagagcgagugcgugugugucaacggcucuugcuuuacaauuaugaccgauggccccagcaauggggcugccuccuacaaaaucuucaagaucgaaaagggaaaagugacaaagucuauugagcugaacgcuccuaauuuucacuaugaagaguguagcugcuacccggacaccggcaccgugaugugugucugccgcgauaacuggcacggguccaauagacccuggguuagcuucaaccagaaucuugacuaccagaucggauauauuugcucuggcguguuuggggauaacccucggcccaaagacggaaagggcuccuguaauccugugacagucgauggcgccgacggggugaaaggauucagcuacaaguauggcaacgggguuuggaucggacgcacgaaaucuaauagacugcggaagggcuuugagaugauuugggaccccaacggguggaccgauacagacuccgauuucagcgugaagcaagacgucguggcgaucaccgauugguccggcuacucuggauccuuuguucagcauccggaacucacaggccuggacugcauucgcccuuguuucuggguggagcuugucagagggcugccccgggaaaauaccacgaucuggacauccggaucuagcaucuccuucugcggcguggauagcgacaccgccaacuggucuuggccugauggggcugagcuccccuuuaccauugacaaauga

SEQ ID NO: 199108 - RNA, 1413 nt, Artificial Sequence; identical to SEQ ID NO: 199095
  derived and/or modified sequence opt5 from neuraminidase__InfluenzaA__ABV30330

SEQ ID NO: 199109 - RNA, 1413 nt, Artificial Sequence; identical to SEQ ID NO: 199054
  derived and/or modified sequence opt5 from neuraminidase__InfluenzaA__ABV30341

SEQ ID NO: 199110 - RNA, 1413 nt, Artificial Sequence; identical to SEQ ID NO: 199054
  derived and/or modified sequence opt5 from neuraminidase__InfluenzaA__ABV30363

SEQ ID NO: 199111 - RNA, 1413 nt, Artificial Sequence; identical to SEQ ID NO: 199054
  derived and/or modified sequence opt5 from neuraminidase__InfluenzaA__ABV30374

SEQ ID NO: 199112 - RNA, 1410 nt, Artificial Sequence
  derived and/or modified sequence opt5 from neuraminidase__InfluenzaA__ABV30385
augaaccccaaucagaagaucauuaccaucggcagcgugucccugacaauuucuacgaucugcuucuuuaugcaaauugccauccucaucaccacagucacccugcacuucaaacaguacgaguuuagcccuccgcccaacaaucagguuaugcuuugugaaccuacaauuaucgagagaaacauuaccgaaaucguguaucugacaaauaccacgauugagaaggaaaucugccccaaacucgcugaguaccggaacugguccaagccucagugugacauuaccggguucgcccccuuuucuaaagauaauagcauccgccuguccgcgggaggcgacaucugggugacaagagagccuuaugucucuugcgauccggacaaguguuaccaauucgcucuugggcagggaaccacacugaacaaugugcauagcaacgauaccguucacgaccggacgcccuaucgcacacuccugaugaaugaacugggcgugccuuuucaucucgggaccaagcaggucugcauugccugguccagcagcuccugucacgauggaaaagccuggcugcaugugugcguuacaggcgacgauaagaacgcuaccgccagcuucaucuacaauggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccccgcuacccuggcgugagaugugucugccgggauaauuggaaggggagcaaccgccccaucguggacauuaacaucaaagacuacucuauuguuuccagauauguguguagcggacuugucggcgauaccccgcggaagaaugacucuagcuccucuagccauugccuggauccuaacaaugaggaaggcgggcacggagugaaaggcugggccuucgacgaugggaacgacguuuggaugggacgcacgaucuccgagaagucuagaucuggcuacgagacauuuaaagugaucgaagggugguccaaucccaacagcaagcuccagauuaaucggcaggucaucguggaucgcggaaacagaucuggcuauuccggcauuuucagcgucgaggggaaauccuguaucaaucggugcuuuuacguggaacugauuagaggacgcaaggaggaaaccgagguucuguggaccucuaacagcaucguggucuucuguggcacauccgggaccuauggaacaggcucuuggccugacggggcugauauuaaucucaugcccaucuga

SEQ ID NO: 199113 - RNA, 1410 nt, Artificial Sequence
  derived and/or modified sequence opt5 from neuraminidase__InfluenzaA__ABV30396
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucucugaguaccggaauuggagcaagccucaguguaacauuaccggguucgcucccuuuuccaaagacaauucuauccgccugagcgccggaggcgauaucugggugacaagagagccuuaugucuccugcgaccccgauaaguguuaccaauucgcgcuugggcagggaaccacacugaacaaugugcauagcaacgacaccguucacgaucggacgccuuaucgcacacuccugaugaaugaacugggcgugccguuucaucucgggaccaagcaggucugcauugcuuggucuuccagcucuugucacgacggaaaagccuggcugcaugugugcguuacaggcgaugacaagaacgccaccgcuuccuucaucuacaauggcagacuuguggauagcauugucucuugguccaaagagauccugcggacccaggaaagcgagugugugugcauuaacgggacauguacgguggucaugaccgacggauccgccucuggcaaggcugauacaaaaauccucuuuaucgaggaagggaagauuguucacaccagcacacuguccggaagcgcccaacacguggaggaaugcucuugcuauccccgcuacccuggcgugagaugugucugccgggacaacuggaagggguccaaucgccccaucguggauauuaacaucaaagacuacagcauuguuucuagcuauguguguuccggacuugucggcgacaccccuagaaagaaugauucuagcuccagcucucauugccuggaccccaacaaugaggaaggcgggcacggagugaaaggcugggcguucgaugacgggaacgauguuuggaugggacggacgaucuccgagaagcuccgcagcggcuacgagacauuuaaagugaucgaaggguggucuaauccgaacuccaagcugcagauuaauagacaggucaucguggaccggggaaaccgcagcggcuauuccggcauuuucucugucgaggggaaaagcuguaucaauagaugcuuuuacguggaacugauucggggaagaaaggaggaaaacgagguucucuggaccuccaauucuaucguggucuucuguggcaccagcgggacauauggaaccggcuccuggccugauggggccgacauuaaccugaugcccaucuga

SEQ ID NO: 199114 - RNA, 1410 nt, Artificial Sequence
  derived and/or modified sequence opt5 from neuraminidase__InfluenzaA__ABV30407
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcggccauugccuggauccgaauaacgaggaagggggacacggcgucaaagggugggccuucgacgauggaaaugacguguggaugggccgcaccaucuccgagaagucuagacucggguaugagacauuuaaaguuauugaaggauggucuaacccuaaguccaaacugcagaucaaucgccaggugauugucgaucggggcaacagaagcggcuacucugggaucuucuccguggagggaaagagcuguauuaaucggugcuuuuaugucgaacugaucagaggccgcaaggaggaaaccgaggugcucuggaccuccaacucuauuguuguguucugugggacaagcggaaccuacggcacaggguccuggcccgacggcgcugauaucaaucugaugccuaucuga

SEQ ID NO: 199115 - RNA, 1410 nt, Artificial Sequence
  derived and/or modified sequence opt5 from neuraminidase__InfluenzaA__ABV30418
augaaccccaaucagaagaucauuaccaucggcagcgugucccugacaauuucuacgaucugcuucuuuaugcaaauugccauccucaucaccacagucacccugcacuucaaacaguacgaguuuagcucccuuccuaacaaucagguuaugcugugugaaccgacaauuaucgagagaaacauuaccgaaaucguguaucucacaaauaccacgauugagaaggaaaucugccccaaacuggcugaguaccggaacuggucuaagccucagugugacauuaccggguucgcccccuuuagcaaagauaauuccauccgccuuucugcgggaggcgacaucugggugacaagagagccuuaugucagcugcgaucccgacaaguguuaccaauucgcucuggggcagggaaccacacucaacaaugugcauuccaacgauaccguucacgaccggacgccuuaucgcacacugcugaugaaugaacucggcgugccguuucaucuggggaccaagcaggucugcauugccuggucuagcuccagcugucacgauggaaaagccuggcuucaugugugcguuacaggcgacgauaagaacgcuaccgccucuuucaucuacaauggcagacugguggacuccauugucagcuggucuaaagagauccuccggacccaggaauccgagugugugugcauuaacgggacauguacgguggucaugaccgauggaagcgcuuccggcaaggccgacacaaaaauccuguuuaucgaggaagggaagauuguucacaccucuacacuuagcggauccgcgcaacacguggaggaaugcagcugcuauccccgcuacccuggcgugagaugugucugccgggauaauuggaaggggucuaaccgccccaucguggacauuaacaucaaagacuacuccauuguuagcagauauguguguucuggacuggucggcgauaccccucggaagaaugacagcuccucuagcucccauugccucgaucccaacaaugaggaaggcgggcacggagugaaaggcugggccuucgacgaugggaacgacguuuggaugggacgcacgaucagcgagaagucuagauccggcuacgagacauuuaaagugaucgaaggguggagcaauccgaacucuaagcugcagauuaaucggcaggucaucguggaucgcggaaacagauccggcuauagcggcauuuucuccgucgaggggaaaucuuguaucaaucggugcuuuuacguggaacugauuagaggacgccgggaggaaaccgagguucucuggaccagcaacuccaucguggucuucuguggcacaucugggaccuauggaacaggcagcuggccugacggggcugauauuaaucugaugcccaucuga

SEQ ID NO: 199116 - RNA, 1410 nt, Artificial Sequence; identical to SEQ ID NO: 199081
  derived and/or modified sequence opt5 from neuraminidase__InfluenzaA__ABV30429

SEQ ID NO: 199117 - RNA, 1410 nt, Artificial Sequence; identical to SEQ ID NO: 199081
  derived and/or modified sequence opt5 from neuraminidase__InfluenzaA__ABV30440

SEQ ID NO: 199118 - RNA, 1410 nt, Artificial Sequence; identical to SEQ ID NO: 199081
  derived and/or modified sequence opt5 from neuraminidase__InfluenzaA__ABV30451

SEQ ID NO: 199119 - RNA, 1413 nt, Artificial Sequence; identical to SEQ ID NO: 199054
  derived and/or modified sequence opt5 from neuraminidase__InfluenzaA__ABV30462

SEQ ID NO: 199120 - RNA, 1410 nt, Artificial Sequence; identical to SEQ ID NO: 199081
  derived and/or modified sequence opt5 from neuraminidase__InfluenzaA__ABV30473

SEQ ID NO: 199121 - RNA, 1410 nt, Artificial Sequence
  derived and/or modified sequence opt5 from neuraminidase__InfluenzaA__ABV30484
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagauauguguguagcggacuugucggcgauacgccccggaagaacgacucuagcuccaauucucauugccuggauccgaacaaugaggaaggcgggcacggagugaaaggcugggccuucgacgaugggaacgacguuuggaugggacgcaccaucagcgagaaguccagaagcggcuacgagacauuuaaagugaucgaaggguggucuaauccuaacuccaagcuccagauuaaucggcaggucaucguggaucgcggaaacagaagcggcuauucuggcauuuucuccgucgaggggaaaagcuguaucaaucggugcuuuuacguggaacugauuagaggacgcaaggaggaaaccgagguucuguggaccuccaacucuaucguggucuucuguggcacaagcgggaccuauggaacaggcuccuggcccgacggggcugauauuaaucucaugccuaucuga

SEQ ID NO: 199122 - RNA, 1413 nt, Artificial Sequence; identical to SEQ ID NO: 199093
  derived and/or modified sequence opt5 from neuraminidase__InfluenzaA__ABV30495

SEQ ID NO: 199123 - RNA, 1413 nt, Artificial Sequence; identical to SEQ ID NO: 199054
  derived and/or modified sequence opt5 from neuraminidase__InfluenzaA__ABV30506

SEQ ID NO: 199124 - RNA, 1410 nt, Artificial Sequence; identical to SEQ ID NO: 199090
  derived and/or modified sequence opt5 from neuraminidase__InfluenzaA__ABV30517

SEQ ID NO: 199125 - RNA, 1413 nt, Artificial Sequence
  derived and/or modified sequence opt5 from neuraminidase__InfluenzaA__ABV30528
augaacagcaaucagaagaucauuaccaucggcuccauuucuaucgccauugggaucaucagccugaugcuccaaauuggaaacaucauuuccaugugggcuucucacagcauccagacaggcucccagaaucauacggggauuugcaaccagagaaucauuaccuacgagaauagcacaugggugaaccacaccuaugucaauaucaacaauacaaacguuguggccggaaaagacaagaccagcgugacacuggcgggcaauuccagccuuuguucuaucuccgggugggcuauuuacaccaaagauaacagcauccggauuggaucuaagggcgacgucuucgugauccgcgaacccuuuauuuccugcagccaucuggaguguagaacguucuuucucacccaaggcgcccugcuuaaugauaaacacucuaacgggacaguuaaggaccgguccccuuaucgcgcccugaugagcugcccgcucggagaagcucccuccccuuacaauucuaaguucgagagcguggccugguccgcuagcgccugucaugauggcaugggguggcugaccaucggaaucucuggccccgacaacggggcggucgccgugcugaaauauaacggaauuaucacagaaaccauuaaguccuggaaaaagagaauccuccggacgcaggagagcgagugcguuugugugaauggcucuugcuuuacaauuaugaccgauggcccuagcaacggggcugccuccuacaaaaucuucaagaucgaaaagggaaaagucacaaagucuauugagcugaaugcucccaacuuucacuaugaagaguguagcugcuacccugacaccggcaccgugaugugugugugccgcgauaauuggcacggguccaacagaccgugggucagcuucaaucagaaccuugacuaccagguuggauauaucugcucuggcguguuuggggauaauccccggccuaaagacggaaagggcuccuguaaccccaugacaguggauggcgccgacggggucaaaggauucagcuacaaguauggcaaugggguguggauuggacgcacgaaaucuaacaagcugagaaagggcuuugagaugaucugggacccuaauggguggaccgauacagacuccgauuucagcguuaaacaagacguggucgcgauuaccgauugguccggcuacucuggaucuuuugugcagcaucccgaacucacaggccuggacugcauccggccguguuucuggguugagcuugugcgcgggcugccuagagaaaacgccaccauuuggacguccggaucuagcaucuccuucugcggcgucgauagcgacacagcuaauuggucuuggcccgauggggccgagcucccuuuuaccaucgacaaguga

SEQ ID NO: 199126 - RNA, 1413 nt, Artificial Sequence; identical to SEQ ID NO: 199054
  derived and/or modified sequence opt5 from neuraminidase__InfluenzaA__ABV30539

SEQ ID NO: 199127 - RNA, 1413 nt, Artificial Sequence; identical to SEQ ID NO: 199054
  derived and/or modified sequence opt5 from neuraminidase__InfluenzaA__ABV30561

SEQ ID NO: 199128 - RNA, 1413 nt, Artificial Sequence; identical to SEQ ID NO: 199054
  derived and/or modified sequence opt5 from neuraminidase__InfluenzaA__ABV30572

SEQ ID NO: 199129 - RNA, 1413 nt, Artificial Sequence; identical to SEQ ID NO: 199054
  derived and/or modified sequence opt5 from neuraminidase__InfluenzaA__ABV30583

SEQ ID NO: 199130 - RNA, 1413 nt, Artificial Sequence; identical to SEQ ID NO: 199054
  derived and/or modified sequence opt5 from neuraminidase__InfluenzaA__ABV30594

SEQ ID NO: 199131 - RNA, 1413 nt, Artificial Sequence
  derived and/or modified sequence opt5 from neuraminidase__InfluenzaA__ABV30605
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggugggaaaagacaagaccagcgucacacuggccggcaacuccagccuuuguucuauuuccgggugggcgaucuacaccaaagauaauagcauucggaucggaucuaagggcgacguguucguuauucgcgaaccuuuuaucuccugcagccaucuggaguguagaacguucuuucucacccaaggcgcucugcuuaacgauaaacacucuaaugggacagugaaggaccgguccccguaucgcgcccugaugagcugcccccucggagaagccccuucccccuacaacucuaaguucgagagcgucgcuugguccgccagcgcuugucaugauggcaugggguggcugaccaucggaauuucuggcccugacaauggggccguggcgguucugaaauauaacggaaucauuacagaaaccaucaaguccuggaaaaagcggauucucagaacgcaggagagcgagugcgugugugucaacggcucuugcuuuacaaucaugaccgauggccccagcaauggggccgcuuccuacaaaaucuucaagauugaaaagggaaaagugacaaagucuaucgagcugaacgccccuaauuuucacuaugaagaguguagcugcuacccggacaccggcaccgugaugugugucugccgcgauaacuggcacggguccaauagacccuggguuagcuucaaccagaaucuugacuaccagauuggauauaucugcucuggcguguuuggggauaacccucggcccaaagacggaaagggcuccuguaauccugugacagucgauggcgcugacggggugaaaggauucagcuacaaguauggcaacgggguuuggauuggacgcacgaaaucuaauagacugcggaagggcuuugagaugaucugggaccccaacggguggaccgauacagacuccgauuucagcgugaagcaagacgucguggccauuaccgauugguccggcuacucuggauccuuuguucagcauccggaacucacaggccuggacugcauccgcccuuguuucuggguggagcuugucagagggcugccccgggaaaauaccacgaucuggacauccggaucuagcauuuccuucugcggcguggauagcgacaccgcgaacuggucuuggccugauggggccgagcuccccuuuaccaucgacaaauga

SEQ ID NO: 199132 - RNA, 1413 nt, Artificial Sequence; identical to SEQ ID NO: 199054
  derived and/or modified sequence opt5 from neuraminidase__InfluenzaA__ABV30616

SEQ ID NO: 199133 - RNA, 1413 nt, Artificial Sequence; identical to SEQ ID NO: 199054
  derived and/or modified sequence opt5 from neuraminidase__InfluenzaA__ABV30627

SEQ ID NO: 199134 - RNA, 1410 nt, Artificial Sequence
  derived and/or modified sequence opt5 from neuraminidase__InfluenzaA__ABV30649
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaacgccgacacaaagauccucuuuauugaggaagggaaaaucguccauaccuccacacugucuggaagcgcgcaacacguugaggaaugcuccugcuauccuagauaccccggcgugcggugugugugccgcgauaacuggaaggggagcaauagaccuauugucgacaucaacauuaaggaccacucuaucguguccagcuacguuuguucuggacuugugggcgauacgccccggaaaaaugacagcuccucuagcucccauugccuggauccgaacaaugaggaaggcgggcacggagucaagggcugggccuucgacgaugggaacgacguguggaugggacgcaccaucagcgagaaaucuagacucggcuaugagacauuuaagguuauugaagggugguccaauccuaaaagcaagcugcagaucaaccgccaggugauugucgaucggggaaauagaucuggcuacuccggcaucuucagcguggaggggaaauccuguauuaaccggugcuuuuaugucgaacugaucagaggacgcaaggaggaaaccgaggugcucuggaccucuaauagcauuguuguguucuguggcacauccgggaccuacggaacaggcucuuggcccgacggggcugauaucaaccugaugccuaucuga

SEQ ID NO: 199135 - RNA, 1410 nt, Artificial Sequence; identical to SEQ ID NO: 198908
  derived and/or modified sequence opt5 from neuraminidase__InfluenzaA__ABV30660

SEQ ID NO: 199136 - RNA, 1413 nt, Artificial Sequence
  derived and/or modified sequence opt5 from neuraminidase__InfluenzaA__ABV45852
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccaacaauggggcugccucuuacaaaaucuucaagauugaaaagggaaaagucacaaagagcaucgagcugaacgcuccuaauuuucacuaugaagaguguuccugcuacccggacaccggcaccgugaugugugugugccgcgauaacuggcacgggucuaauagacccugggucagcuucaaccagaaucuugacuaccagauuggauauaucugcuccggcguuuuuggggauaacccucggcccaaagacggagagggcagcuguaauccugugacaguggauggcgccgacggggucaagggauucucuuacaaauauggcaacgggguguggauuggacgcacgaaguccaauagacugcggaaaggcuuugaaaugaucugggaccccaacggguggaccgauacagacagcaauuucucuguuaagcaagauguggucgcgauuaccgacugguccggcuacagcggauccuuugugcagcauccggagcucacaggccuggauugcauccgcccuuguuucuggguugaacuugugagagggcugccccgggagaacaccacgaucuggacaucuggaagcuccauuucuuucugcggcgucaacagcgacaccgccaauugguccuggccugauggggcugaacuccccuuuaccaucgacaaguga

SEQ ID NO: 199137 - RNA, 1410 nt, Artificial Sequence; identical to SEQ ID NO: 198908
  derived and/or modified sequence opt5 from neuraminidase__InfluenzaA__ABV45863

SEQ ID NO: 199138 - RNA, 1413 nt, Artificial Sequence
  derived and/or modified sequence opt5 from neuraminidase__InfluenzaA__ABV45874
augaaccccaaucagaagaucauuaccaucggcagcauuuccaucgccauugggaucaucucucugaugcuccaaauuggaaacaucauuagcaucugggcuuccuacucuauucagacaggcagccagaaucacacggggaucugcaaccagagaauuaucaccuaugagaauagcacaugggugaaccauaccuacgucucuaucaauaacacaaauguuguggccggaaaagacaagaccagcgugacacuggcgggcaacuccagccuuuguucuauuuccgggugggcuaucuauaccaaagauaauagcauucggaucggaucuaagggcgacgucuucgugauucgcgaaccuuuuaucuccugcagccaccuggaguguagaacguucuuucucacccaaggcgcccugcuuaacgauaaacauucuaaugggacaguuaaggaccgguccccguaccgcgcccugaugagcugcccccucggagaagcuccuucccccuauaacucuaaguucgagagcguggccugguccgcuagcgccugucacgauggcaugggguggcugaccaucggaauuucuggcccugacaauggggcggucgccgugcugaaauacaacggaaucauuacagaaaccaucaaguccuggaaaaagcggauucucagaacgcaggagagcgagugcguuugugugaacggcucuugcuuuacaaucaugaccgauggccccagcaauggggcugccuccuauaaaaucuucaagauugaaaagggaaaagucacaaagucuaucgagcugaacgcuccuaauuuucauuacgaagaguguagcugcuacccggacaccggcaccgugaugugugugugccgcgauaacuggcacggguccaauagacccugggucagcuucaaccagaaucuugacuaucagauuggauacaucugcucuggcguuuuuggggauaacccucggcccaaagacggaaagggcuccuguaauccugugacaguggauggcgccgacggggucaaaggauucagcuauaaguacggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuauucuggauccuuugugcagcacccggaacucacaggccuggacugcauccgcccuuguuucuggguugagcuugugagagggcugccccgggaaaauaccacgaucuggacauccggaucuagcauuuccuucugcggcgucgauagcgacaccgccaacuggucuuggccugauggggcugagcuccccuuuaccaucgacaaauga

SEQ ID NO: 199139 - RNA, 1413 nt, Artificial Sequence; identical to SEQ ID NO: 199054
  derived and/or modified sequence opt5 from neuraminidase__InfluenzaA__ABV45885

SEQ ID NO: 199140 - RNA, 1413 nt, Artificial Sequence; identical to SEQ ID NO: 199067
  derived and/or modified sequence opt5 from neuraminidase__InfluenzaA__ABV45896

SEQ ID NO: 199141 - RNA, 1413 nt, Artificial Sequence; identical to SEQ ID NO: 199054
  derived and/or modified sequence opt5 from neuraminidase__InfluenzaA__ABV45918

SEQ ID NO: 199142 - RNA, 1413 nt, Artificial Sequence
  derived and/or modified sequence opt5 from neuraminidase__InfluenzaA__ABV45929
augaaccccaaucagaagaucauuaccaucggcagcauuuccaucgccauugggaucaucucucugaugcuccaaauuggaaacaucauuagcaugugggcuucccacucuauccagacaggcagccagaaucauacggggauuugcaaccagagaaucauuaccuacgaaaauuccacaugggugaaccacaccuaugucaauaucaacaauacaaacguugugaccggaaaagacaagacaucugugacccuggccggcaauagcucccuuuguagcaucucugggugggcgauuuacacgaaagauaacuccauccggauuggaagcaagggcgacgucuucgugauccgcgagccuuuuauuucuugcucccaucuggaguguagaaccuucuuucucacacaaggcgcucugcuuaaugauaaacacagcaacgggaccguuaaggaccggucuccguaucgcgcccugauguccugcccccucggagaagccccuagccccuacaauuccaaguucgagucuguggcuuggagcgccuccgcuugucaugauggcaugggguggcugacaaucggaaucagcggcccugacaacggggccgucgcggugcugaaauauaacggaauuaucaccgaaacgauuaagucuuggaaaaagagaauccuccggacacaggaguccgagugcguuugugugaauggcagcugcuuuaccauuaugacagauggccccucugacggggccgcuagcuacaaaaucuucaagaucgaaaagggaaaagucaccaaguccauugagcugaacgccccuaauuuucacuaugaagaguguucuugcuacccggauaccggcacagugaugugugugugccgcgacaacuggcacgggagcaauagacccugggucuccuucaaccagaaucuugauuaccagaucggauauauuugcagcggcguuuuuggggacaacccucggcccaaagauggaaagggcucuuguaauccugugacgguggacggcgcugacggggucaaaggauucuccuacaaguauggcaacgggguguggaucggacgcaccaaaagcaauaagcugagaaagggcuuugagaugauuugggaucccaacggguggacagacaccgauaaugacuucucuguuaaacaagauguggucgccaucacagacugguccggcuacagcggauccuuugugcagcauccggaacucaccggccuggauugcauucggccuuguuucuggguugagcuugugcgcgggcugcccagagaaaacgcgacgaucuggacaucuggaagcuccaucucuuucugcggcgucgacagcgauaccgccaauugguccuggccugacggggcugagcuccccuuuaccauugauaaguga

SEQ ID NO: 199143 - RNA, 1413 nt, Artificial Sequence
  derived and/or modified sequence opt5 from neuraminidase__InfluenzaA__ABV45940
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuauccgguacgagaauagcaccugggugaaccacacauaugucaauaucaacaauaccaacguuguggccggaaaagacaagacaucugugacccuggcgggcaauagcucccuuuguagcauuucugggugggcuaucuacacaaaagauaacuccauucgcaucggaagcaagggcgacgucuucgugauuagagaaccuuuuaucucuugcucccaucuggagugucggaccuucuuucucacgcaaggcgcccugcuuaaugauaaacacagcaacgggaccguuaaggaccgcucuccguauagagcccugauguccugcccccucggagaagcuccuagccccuacaauuccaaguucgagucuguggccuggagcgcuuccgccugucaugauggcaugggguggcugacaaucggaauuagcggcccugacaacggggcggucgccgugcugaaauauaacggaaucauuaccgaaacaaucaagucuuggaaaaagcagauucuccggacccaggaguccgagugcguuugugugaauggcagcugcuuuacgaucaugacagauggccccucuaacggggcugccagcuacaaaaucuucaagauugaaaagggaaaagucaccaaguccaucgagcugaaugcuccuaacuuucacuaugaagaguguucuugcuacccggacacaggcaccgugaugugugugugccgcgauaauuggcacgggagcaacagacccugggucuccuucaaucagagccuugacuaccaaguuggauauauuugcucuggcguguuuggggauaacccucggcccaaagacggaaagggcuccuguaauccuaugaccguggauggcgccgacggggucaaaggauucagcuacaaguauggcaacgggguguggaucggacgcacaaaaucuaauaagcugagaaagggcuuugagaugauuugggaccccaacggguggacggauaccgacuccgauuucagcguuaaacaggacguggucgcgaucacagauugguccggcuacucuggauccuuugugcagcauccggaacucaccggccuggacugcauucggccuuguuucuggguugagcuugugcgcgggcugcccagagaaaauacaaccaucuggacguccggaucuagcaucuccuucugcggcgucgauagcgacacagccaacuggucuuggccugauggggcugagcuccccuuuaccauugacaaguga

SEQ ID NO: 199144 - RNA, 1413 nt, Artificial Sequence; identical to SEQ ID NO: 199080
  derived and/or modified sequence opt5 from neuraminidase__InfluenzaA__ABV45951

SEQ ID NO: 199145 - RNA, 1410 nt, Artificial Sequence
  derived and/or modified sequence opt5 from neuraminidase__InfluenzaA__ABV45973
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcgaggccgacacaaagauccucuuuauugaagaggggaaaaucguccauaccuccacacugucuggaagcgcgcaacacguugaagagugcuccugcuauccuagauaccccggcgugcggugugugugccgcgauaacuggaaggggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgagaaaucuagacucggcuaugaaacauuuaagguuauugaggggugguccaacccuaaaagcaagcugcagaucaaucgccaggugauugucgaucggggaaacagaucuggcuacuccggcaucuucagcguggaagggaaauccuguauuaaucggugcuuuuaugucgagcugaucagaggacgcaaggaagagaccgacgugcucuggaccucuaacagcauuguuguguucuguggcacauccgggaccuacggaacaggcucuuggcccgauggggcugacaucaaucugaugccuaucuga

SEQ ID NO: 199146 - RNA, 1410 nt, Artificial Sequence
  derived and/or modified sequence opt5 from neuraminidase__InfluenzaA__ABV45984
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcgggaccgcacgccguauagaacacuccugaugaacgaacugggcguccccuuucaccucgggaccaaacaggugugcaucgccugguccucuagcuccugucaugauggaaaggccuggcugcacguuugcauuacaggcgacgauaagaaugcuaccgccagcuucaucuacaacggccggcuuguggacucuauugucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggcccgacggggcugauauuaaucugaugccuaucuga

SEQ ID NO: 199147 - RNA, 1410 nt, Artificial Sequence; identical to SEQ ID NO: 198908
  derived and/or modified sequence opt5 from neuraminidase__InfluenzaA__ABV45995

SEQ ID NO: 199148 - RNA, 1413 nt, Artificial Sequence; identical to SEQ ID NO: 199067
  derived and/or modified sequence opt5 from neuraminidase__InfluenzaA__ABV82554

SEQ ID NO: 199149 - RNA, 1410 nt, Artificial Sequence; identical to SEQ ID NO: 199090
  derived and/or modified sequence opt5 from neuraminidase__InfluenzaA__ABV82565

SEQ ID NO: 199150 - RNA, 1410 nt, Artificial Sequence; identical to SEQ ID NO: 199090
  derived and/or modified sequence opt5 from neuraminidase__InfluenzaA__ABW36171

SEQ ID NO: 199151 - RNA, 1413 nt, Artificial Sequence; identical to SEQ ID NO: 199106
  derived and/or modified sequence opt5 from neuraminidase__InfluenzaA__ABW36193

SEQ ID NO: 199152 - RNA, 1413 nt, Artificial Sequence; identical to SEQ ID NO: 199054
  derived and/or modified sequence opt5 from neuraminidase__InfluenzaA__ABW36204

SEQ ID NO: 199153 - RNA, 1413 nt, Artificial Sequence
  derived and/or modified sequence opt5 from neuraminidase__InfluenzaA__ABW36215
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaaaggguggcugaccaucggaauuagcggcccugacaacggggcggucgccgugcugaaguauaacggaaucauuacagaaaccaucaaaucuuggaauaagcagauucucagaacgcaggaguccgagugcguuugugugaacggcagcugcuuuacaaucaugaccgauggccccucuaauggggcugccagcuacaaaaucuucaagauugaaaagggaaaagucacaaaguccaucgagcugaacgcuccuaauuuucacuaugaagaguguucuugcuacccggacaccggcaccgugaugugugugugccgggauaacuggcacgggagcaaucgccccugggucuccuucaaccagaaucuugacuaccaaauuggauauaucugcagcggcguuuuuggggauaacccuagacccaaagacggacggggcucuuguaauccugugacaguggauggcgccgacggggucaagggauucuccuacaaauauggcaacgggguguggauuggacgcacgaaguccaauagacugcggaaaggcuuugagaugaucugggaccccaacggguggaccgauacagacucucauuucuccguuaagcaggauguggucgcgauuaccgacuggagcggcuacuccggaucuuuugugcagcacccggaacucacaggccuggauugcaucaagccuuguuucuggguugagcuugugcgcgggcugcccagagaaaauaccacgaucuggacaagcggauccucuauuagcuucugcggcgucgacuccgauaccgccaacuggagcuggccugacggggcugagcuccccuuuaucauugauaaauga

SEQ ID NO: 199154 - RNA, 1413 nt, Artificial Sequence; identical to SEQ ID NO: 199054
  derived and/or modified sequence opt5 from neuraminidase__InfluenzaA__ABW36226

SEQ ID NO: 199155 - RNA, 1413 nt, Artificial Sequence
  derived and/or modified sequence opt5 from neuraminidase__InfluenzaA__ABW36237
augaaccccaaucagaagaucauuaccaucggcagcauuuccaucacaauugggaucaucucucugaugcuccaaauuggaaacaucauuagcaucugggccucccacucuauucagacgggcagccagaaucauaccgggaucugcaaccagagaauuaucacauacgaaaauuccaccugggugaaccacacauaugucaauaucaacaauaccaacguuguggcuggaaaagacaagacaucugugacccuggccggcaauagcucccuuuguagcauuucugggugggcgaucuacacgaaagauaacuccauucggaucggaagcaagggcgacgucuucgugauucgcgagccuuuuaucucuugcucccaucuggaguguagaaccuucuuucucacacaaggcgcucugcuuaaugauaaacacagcaacgggaccguuaaggaccggucuccguaucgcgcccugauguccugcccccucggagaagccccuagccccuacaauuccaaguucgagucuguggcuuggagcgccuccgcuugucaugauggcaugggguggcugacaaucggaauuagcggcccugacaacggggccgucgcggugcugaaauauaacggaaucauuaccgaaacgaucaagucuuggaaaaagcggauucucagaacacaggaguccgagugcguuugugugaauggcagcugcuuuaccaucaugacagauggccccucuaacggggccgcuagcuacaaaaucuucaagauugaaaagggaaaagucaccaaguccaucgagcugaaugccccuaacuuucacuaugaagaguguucuugcuacccggacaccggcacagugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacgguggauggcgcugacggggucaaaggauucuccuacaaguauggcaaugggguguggaucggacgcaccaaaagcaacaagcugagaaagggcuuugagaugauuugggaccccaauggguggacagauaccgacucugauuucuccguuaaacaagacguggucgccaucacagauuggagcggcuacuccggaucuuuugugcagcauccggaacucaccggccuggacugcauucggccuuguuucuggguugagcuugugcgcgggcugcccagagaaaacacgacaaucuggaccagcggauccucuaucagcuucugcggcgucgauuccgacaccgcgaauuggagcuggccugauggggccgagcuccccuuuacaauugacaaguga

SEQ ID NO: 199156 - RNA, 1413 nt, Artificial Sequence; identical to SEQ ID NO: 199054
  derived and/or modified sequence opt5 from neuraminidase__InfluenzaA__ABW36248

SEQ ID NO: 199157 - RNA, 1413 nt, Artificial Sequence
  derived and/or modified sequence opt5 from neuraminidase__InfluenzaA__ABW36259
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggaaaagacaagaccucugugacacuggcgggcaacagcucccuuuguagcauuucugggugggcuaucuacaccaaagauaauuccauucggaucggaagcaagggcgacgucuucgugauucgcgaaccuuuuaucucuugcucccaccuggaguguagaacguucuuucucacccaaggcgcccugcuuaacgauaaacauagcaaugggacaguuaaggaccggucuccguaucgcgcccugauguccugcccccucggagaagcuccuagccccuacaacuccaaguucgagucuguggccuggagcgcuuccgccugucacgauggcaugggguggcugaccaucggaauuagcggcccugacaacggggcggucgccgugcugaaauauaauggaaucauuacaggcaccaucaagucuuggaaaaagcagauucucagaacgcaggaauccgagugcguuuguaugaacggcagcugcuuuacaaucaugaccgaugggcccucuaaucgggcugccagcuacaaaaucuucaagauugagaagggaaaagugacaaaguccaucgaacugaacgcuccuaauuuucauuaugaggaauguucuugcuacccggacaccggcauugucaugugugugugccgcgauaacuggcacgggagcaauagacccuggguguccuucaaccagaaucuugacuaccaaaucggauauauuugcagcggcguccugggggauaacccucggcccgaggacggagagggcucuuguaauccuguuaccguggauggcgccgacggggugaaaggauuuuccuacaaguaugacaacggcgucuggaucgggcgcacaaaaagcaauagacuccggaagggauucgaaaugauuugggaucccaacggcuggacgaauaccgacucugauuuuuccgugaaacaggacguuguggcgaucacagauuggagcggguacuccggcucuuucguccagcacccggagcugaccggacuugacugcauccgcccuuguuuuuggguggaacugguuagaggccucccccgggagaacacaaccauuuggacgagcggguccucuaucagcuucugcggaguguccagcgauacagccaacuggucuuggccugacggcgcugaacugcccuucaccauugauaaguga

SEQ ID NO: 199158 - RNA, 1413 nt, Artificial Sequence; identical to SEQ ID NO: 199054
  derived and/or modified sequence opt5 from neuraminidase__InfluenzaA__ABW36281

SEQ ID NO: 199159 - RNA, 1413 nt, Artificial Sequence; identical to SEQ ID NO: 199054
  derived and/or modified sequence opt5 from neuraminidase__InfluenzaA__ABW36292

SEQ ID NO: 199160 - RNA, 1413 nt, Artificial Sequence; identical to SEQ ID NO: 199067
  derived and/or modified sequence opt5 from neuraminidase__InfluenzaA__ABW36303

SEQ ID NO: 199161 - RNA, 1413 nt, Artificial Sequence
  derived and/or modified sequence opt5 from neuraminidase__InfluenzaA__ABW36314
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugcugaaguauaauggaauuaucacagaaaccauuaagagcuggcgcaaacagauccugagaacgcaggagucugaguguguuugcgugaacggcuccuguuuuacaaucaugaccgacggcccuagcgaugggcaagccucuuaccggauuuucaagaucgaaaaaggaaagauuacaaaaagcaucgagcucgacgcuccgaacuuucauuaugaagagugcuccuguuaccccgauaccggcaccgucaugugcgugugccgcgacaauuggcacgggucuaacagaccuugggugagcuucaaucagaaccuggauuaccagauuggauauaucuguuccggcgucuuuggggacaauccccggccuaaggacggaaagggcagcugcgaucccguuaacguggacggcgccgauggggugaaaggauucucuuaccgcuauggcaauggggucuggauuggaagaacaaaguccaacagcucucggaaaggcuuugagaugaucugggacccgaauggguggacggauaccgacuccaacuuccuugugaagcaggauguuguggcuaugacagacuggagcggcuacuccggaucuuuuguccaacacccugaacugaccggccucgauuguaugcgccccugcuucuggguggagcugaucagagggcggccuagagagaaaacaaccauuuggacgagcggauccucuaucagcuucuguggcguuaauuccgacacagugaacuggagcuggcccgauggggccgaacuucccuuuaccauugacaaguga

SEQ ID NO: 199162 - RNA, 1410 nt, Artificial Sequence
  derived and/or modified sequence opt5 from neuraminidase__InfluenzaA__ABW38366
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugcuuccuggagcaaagagauccugcggacccaggaaucugagugugucugcauuaacgggacauguacgguggugaugaccgacggauccgccagcggcaaggcggauacaaaaauccucuuuaucgaggaagggaagauuguccacaccuccacacugucuggaagcgcccaacacguugaggaaugcuccugcuauccucgcuaccccggcgugagaugugugugccgggacaacuggaaggggagcaaucgcccuaucgucgauauuaacaucaaagacuacucuauuguguccagcuauguuuguucuggacuugugggcgacacccccagaaagaaugauagcuccucuagcucccauugccuggacccgaacaaugaggaaggcgggcacggagucaaaggcugggcuuucgaugacgggaacgauguguggaugggacggacgaucagcgagaagcuccgcucuggcuacgagacauuuaaaguuaucgaagggugguccaauccuaacagcaagcugcagauuaauagacaggugaucgucgaccggggaaaccgcucuggcuauuccggcauuuucagcguggaggggaaauccuguaucaauagaugcuuuuacgucgaacugauucggggaagaaaggaggaaaccgaggugcucuggaccucuaacagcaucguuguguucuguggcacauccgggaccuauggaacaggcucuuggcccgauggggccgacauuaaucugaugccuaucuga

SEQ ID NO: 199163 - RNA, 1413 nt, Artificial Sequence; identical to SEQ ID NO: 199153
  derived and/or modified sequence opt5 from neuraminidase__InfluenzaA__ABW39780

SEQ ID NO: 199164 - RNA, 1413 nt, Artificial Sequence
  derived and/or modified sequence opt5 from neuraminidase__InfluenzaA__ABW39809
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagacccuggugacacuugcgggcaacagcucccuguguagcauuucugggugggcuaucuacaccaaagauaauuccauucggaucggaagcaagggcgacgucuucgugauucgcgagccuuuuaucucuugcucccaucucgaguguagaacguucuuucugacccaaggcgcccuucugaacgauaaacacagcaaugggacaguuaaggaccggucuccguaucgcgcccucauguccugcccccugggagaagcuccuagccccuacaacuccaaguucgagucuguggccuggagcgcuuccgccugucaugauggcaugggguggcugaccaucggaauuagcggcccugacaauggggcggucgccgugcucaaauauaacggaaucauuacagaaaccaucaagucuuggaaaaagcggauucugagaacgcaggaguccgagugcguuugugugaacggcagcugcuuuacaaucaugaccgauggccccucuaauggggcugccagcuacaaaaucuucaagauugaaaagggaaaagucacaaaguccaucgagcuuaacgcuccuaauuuucacuaugaagaguguucuugcuacccggacaccggcaccgugaugugugugugccgcgauaacuggcacgggagcaauagacccugggucuccuucaaccagaaucuggacuaccagauuggauauaucugcagcggcguuuuuggggauaacccucggcccaaagacggaaagggcucuuguaauccugugacaguggauggcgccgacggggucaaaggauucuccuacaaguauggcaacgggguguggauuggacgcacgaaaagcaauagacuccggaagggcuuugagaugaucugggaccccaacggguggaccgauacagacucugauuucuccguuaagcaagacguggucgcgauuaccgauuggagcggcuacuccggaucuuuugugcagcauccggaacugacaggccuugacugcauccgcccuuguuucuggguugagcuggugagagggcucccccgggaaaauaccacgaucuggacaagcggauccucuauuagcuucugcggcgucgauuccgacaccgccaacuggagcuggccugauggggcugagcugcccuuuaccaucgacaaauga

SEQ ID NO: 199165 - RNA, 1413 nt, Artificial Sequence; identical to SEQ ID NO: 199067
  derived and/or modified sequence opt5 from neuraminidase__InfluenzaA__ABW39820

SEQ ID NO: 199166 - RNA, 1413 nt, Artificial Sequence
  derived and/or modified sequence opt5 from neuraminidase__InfluenzaA__ABW39831
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggucggcaauucuagccuuuguuccauuagcgggugggcgaucuacaccaaagauaacucuauucggaucggauccaagggcgacguguucguuauucgcgagccguuuaucagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccauuggaaucuccggccccgacaacggggccguggcgguucugaaguauaacggaauuaucacaggcaccauuaaaagcuggaagaaacagauccuccgcacgcaggaaucugagugcguguguaugaauggcuccugcuuuacaaucaugaccgaugggccuagcaacggagccgcuucuuacaagauuuucaagaucgagaaaggcaaggucacaaaaagcauggaacugaaugccccgaacuuucacuaugaggaauguuccugcuaccccgacaccgggaccgugaugugugugugcagagauaauuggcacggaucuaaccggccuugggucagcuucaaucagaaccuugacuaccaaauuggcuauaucugcuccgggguuuuuggagauaauccccgcccuaaggacggcgagggcagcuguaaccccgugacaguggauggggcuaauggagucaaaggcuucucuuacaaguaugggaacggaguguggauuggcagaacgaaauccaaucggauccgcaagggguuugagaugauuugggacccgaacggcuggaccaauacagacagcgauuucucuguuaagcaggacaucguggccaucaccgauugguccggauacagcggcuccuuuguccagcauccugaacugacagggcucgacugcauuagacccuguuucuggguggagcugguucggggacuuccucgcgaaaacaccacgaucuggacaucuggcagcuccauuucuuucugcggggugaacggagauaucgcgaauuggagcuggcccgacggcgccgagcugcccuuuaccauugauaaauga

SEQ ID NO: 199167 - RNA, 1413 nt, Artificial Sequence; identical to SEQ ID NO: 199080
  derived and/or modified sequence opt5 from neuraminidase__InfluenzaA__ABW39842

SEQ ID NO: 199168 - RNA, 1413 nt, Artificial Sequence; identical to SEQ ID NO: 199054
  derived and/or modified sequence opt5 from neuraminidase__InfluenzaA__ABW39864

SEQ ID NO: 199169 - RNA, 1410 nt, Artificial Sequence; identical to SEQ ID NO: 199090
  derived and/or modified sequence opt5 from neuraminidase__InfluenzaA__ABW39875

SEQ ID NO: 199170 - RNA, 1413 nt, Artificial Sequence
  derived and/or modified sequence opt5 from neuraminidase__InfluenzaA__ABW39886
augaaccccaaucagaagaucauuaccaucggcagcauuuccaucgccauugggaucaucucucugauucuccaaaucggaaacauuaucagcauuugggcuucccacucuauccagacaagaaaucagaaccauacgggcauuugcaaucagcggaucaucaccuacgagaacagcacaugggugaaucacaccuaugucuccauuaacaauacaaacguuguggccgggaaagacaagaccucugugacacuggcgggaaauagcucccuuuguagcaucucuggcugggcuauuuacaccaaagauaacuccauccgcauugggagcaagggagacgucuucgugaucagagaaccuuuuaucucuugcucccaucuggagugucggacguucuuucucacccaaggcgcccugcuuaaugauaaacacagcaacggcacaguuaaggaccgcucuccguauagagcccugauguccugcccccucggggaagcuccuagccccuacaauuccaaguucgagucuguggccuggagcgcuuccgccugucaugauggaaugggcuggcugaccauugggaucagcggaccugacaacggcgcggucgccgugcugaaauauaacgggauuaucacagaaaccauuaagucuuggaaaaagcggauccuccgcacgcaggaguccgagugcguuugugugaauggaagcugcuuuacaaucaugaccgauggccccucuaacggcgcugccagcuacaaaauuuucaagaucgaaaaggggaaagucacaaaguccauugagcugaaugcuccuaacuuucacuaugaagaguguucuugcuacccggacaccggaaccgugaugugugugugcagagauaauuggcacggcagcaaccggcccugggucuccuucaaucagaaccuugacuaccagaucggguauauuugcagcggaguuuuuggcgauaauccucgccccaaagacgggaagggaucuuguaacccugugacaguggauggcgccgacggcgucaaaggguucuccuacaaguauggaaauggcguguggaucgggagaacgaaaagcaaccggcugcgcaagggauuugagaugauuugggaccccaauggcuggaccgauacagacucugauuucuccguuaagcaagacguggucgcgaucaccgauuggagcggguacuccggcucuuuugugcagcauccggaacucacaggacuggacugcaucagaccuuguuucuggguugagcuugugcggggccugccccgcgaaaacaccacgauuuggacaagcggguccucuaucagcuucugcggagucgauuccgacaccgccaauuggagcuggccugauggcgcugagcuccccuuuaccauugacaaauga

SEQ ID NO: 199171 - RNA, 1413 nt, Artificial Sequence; identical to SEQ ID NO: 199054
  derived and/or modified sequence opt5 from neuraminidase__InfluenzaA__ABW39897

SEQ ID NO: 199172 - RNA, 1413 nt, Artificial Sequence
  derived and/or modified sequence opt5 from neuraminidase__InfluenzaA__ABW39908
augaaccccaaucagaagaucauuaccaucggcagcauuuccaucgccauugggaucacaucucugaugcuccaaaucggaaacauuaucagcauuugggcuucccacucuauccagacgggcagccagaaucauaccgggauuugcaaccagagaaucauuacauacgagaauagcaccugggugaaccacacauaugucucuaucaauaacaccaauguuguggccggaaaagacaagacaagcgugacccuggcgggcaacuccagccuuuguucuaucuccgggugggcuauuuacacgaaagauaauagcauccggauuggaucuaagggcgacgucuucgugauccgcgaaccuuuuauuuccugcagccaucuggaguguagaaccuucuuucucacacaaggcgcccugcuuaacgauaaacacucuaaugggaccguuaaggaccgguccccguaucgcgcccugaugagcugcccccucggagaagcuccuucccccuacaacucuaaguucgagagcguggccugguccgcuagcgccugucaugauggcaugggguggcugacaaucggaaucucuggcccugacaauggggcggucgccgugcugaaauauaacggaauuaucaccgaaacgauuaaguccuggaaaaagagaauccuccggacacaggagagcgagugcguuugugugaacggcucuugcuuuaccauuaugacagauggccccagcaauggggcugccuccuacaaaaucuucaagaucgaaaagggaaaagucaccaagucuauugagcugaacgcuccuaauuuucacuaugaagaguguagcugcuacccggacaccggcacagugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacgguggauggcgccgacggggucaaaggauucagcuacaaguauggcaacgggguguggaucggacgcaccaaaucuaauagacugcggaagggcuuugagaugauuugggaccccaacggguggacagauaccgacuccgauuucagcguuaagcaagacguggucgcgaucacagauugguccggcuacucuggauccuuugugcagcauccggaacucaccggccuggacugcauucgcccuuguuucuggguugagcuugugagagggcugccccgggaaaauacgacaaucuggaccuccggaucuagcaucuccuucugcggcgucgauagcgacaccgccaacuggucuuggccugauggggcugagcuccccuuuacaauugacaaauga

SEQ ID NO: 199173 - RNA, 1413 nt, Artificial Sequence
  derived and/or modified sequence opt5 from neuraminidase__InfluenzaA__ABW39930
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcgacggggcugccuccuacaaaaucuucaagauugaaaagggaaaagucacaaagucuaucgagcugaaugcuccuaacuuucacuaugaagaguguagcugcuacccggauaccggcaccgugaugugugugugccgcgacaauuggcacggguccaacagacccugggucagcuucaaucagaaccuugauuaccagauuggauauaucugcucuggcguuuuuggggacaauccucggcccaaagauggaaagggcuccuguaacccugugacaguggacggcgccgacggggucaaaggauucagcuacaaguauggcaaugggguguggauuggacgcacgaaaucuaacagacugcggaagggcuuugagaugaucugggaucccaauggguggaccgacacagauuccgacuucagcguuaagcaagauguggucgcgauuaccgacugguccggcuacucuggauccuuugugcagcauccggaacucacaggccuggauugcauccgcccuuguuucuggguugagcuugugagagggcugccccgggaaaacaccacgaucuggacauccggaucuagcauuuccuucugcggcgucgacagcgauaccgccaauuggucuuggccugacggggcugagcuccccuuuaccaucgauaaauga

SEQ ID NO: 199174 - RNA, 1413 nt, Artificial Sequence
  derived and/or modified sequence opt5 from neuraminidase__InfluenzaA__ABW39952
augaaccccaaucagaagaucauuaccaucggcagcauuuccaucacaauugggaucaucucucugaugcuccaaauuggaaacaucauuagcaucugggccucccacucuauucagacgggcagccagaaucauaccgggaugugcaaccagagaaucauuacauacgagaauagcaccugggugaaccacacauaugucucuaucaauaacaccaauguuguggcuggaaaagacaagacaagcgugacccuggccggcaacuccagccuuuguucuaucuccgggugggcgauuuacacgaaagauaauagcauccggauuggaucuaagggcgacgucuucgugauccgcgaaccuuuuauuuccugcagccaucuggaguguagaaccuucuuucucacacaaggcgcucugcuuaacgauaaacacucuaaugggaccguuaaggaccgguccccguaucgcgcccugaugagcugcccccucggagaagccccuucccccuacaacucuaaguucgagagcguggcuugguccgccagcgcuugucaugauggcaugggguggcugacaaucggaaucucuggcccugacaauggggccgucgcggugcugaaauauaacggaauuaucaccgaaacgauuaaguccuggaaaaagagaauccuccggacacaggagagcgagugcguuugugugaacggcucuugcuuuaccauuaugacagauggccccagcaauggggccgcuuccuacaaaaucuucaagaucgaaaagggaaaagucaccaagucuauugagcugaacgccccuaauuuucacuaugaagaguguagcugcuacccggacaccggcacagugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacgguggauggcgcugacggggucaaaggauucagcuacaaguauggcaacgggguguggaucggacgcaccaaaucuaauagacugcggaagggcuuugagaugauuugggaccccaacggguggacagauaccgacuccgauuucagcguuaagcaagacguggucgccaucacagauugguccggcuacucuggauccuuugugcagcauccggaacucaccggccuggacugcauucgcccuuguuucuggguugagcuugugagagggcugccccgggaaaauacgacaaucuggaccuccggaucuagcaucuccuucugcggcgucgauagcgacaccgcgaacuggucuuggccugauggggccgagcuccccuuuacaauugacaaauga

SEQ ID NO: 199175 - RNA, 1413 nt, Artificial Sequence; identical to SEQ ID NO: 199054
  derived and/or modified sequence opt5 from neuraminidase__InfluenzaA__ABW39963

SEQ ID NO: 199176 - RNA, 1413 nt, Artificial Sequence; identical to SEQ ID NO: 199054
  derived and/or modified sequence opt5 from neuraminidase__InfluenzaA__ABW39985

SEQ ID NO: 199177 - RNA, 1413 nt, Artificial Sequence
  derived and/or modified sequence opt5 from neuraminidase__InfluenzaA__ABW39996
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacgggacagcuagcuacaaaaucuucaagauugaaaagggaaaagucaccaaguccaucgagcugaaugccccuaacuuucacuaugaagaguguucuugcuacccggacaccggcacagugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacgguggauggcgcugacggggucaaaggauucuccuacaaguauggcaaugggguguggaucggacgcaccaaaagcaacaagcugagaaagggcuuugagaugauuugggaccccaauggguggacagauaccgacucugauuucuccguuaaacaagacguggucgccaucacagauuggagcggcuacuccggaucuuuugugcagcauccggaacucaccggccuggacugcauucggccuuguuucuggguugagcuugugcgcgggcugcccagagaaaacacgacaaucuggaccagcggauccucuaucagcuucugcggcgucgauuccgacaccgcgaauuggagcuggccugauggggccgagcuccccuuuacaauugacaaguga

SEQ ID NO: 199178 - RNA, 1413 nt, Artificial Sequence; identical to SEQ ID NO: 199054
  derived and/or modified sequence opt5 from neuraminidase__InfluenzaA__ABW40007

SEQ ID NO: 199179 - RNA, 1413 nt, Artificial Sequence
  derived and/or modified sequence opt5 from neuraminidase__InfluenzaA__ABW40018
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacgggauuaaaggauucuccuacaaguauggcaauggggucuggaucggacgcacgaaaagcaacagacugcggaagggcuuugagaugauuugggaccccaauggguggaccaacacagauucugacuucuccgugaagcaagauguuguggcgaucaccgacuggagcggcuacuccggaucuuuuguccagcauccggaacucacaggccuggauugcauccgcccuuguuucuggguggagcuuguuagagggcugccccgggaaaauaccacgauuuggacaagcggauccucuaucagcuucugcggcguggacggggauaccgccaacugguccuggccugacggagcugagcuccccuuuaccauugauaaauga

SEQ ID NO: 199180 - RNA, 1410 nt, Artificial Sequence; identical to SEQ ID NO: 198908
  derived and/or modified sequence opt5 from neuraminidase__InfluenzaA__ABW40029

SEQ ID NO: 199181 - RNA, 1413 nt, Artificial Sequence
  derived and/or modified sequence opt5 from neuraminidase__InfluenzaA__ABW40040
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggauuuggaucggacgcacgaaaucuaauagacugcggaagggcuuugagaugauuugggaccccaacggguggaccgauacagacuccgauuucagcgugaagcaagacguuguggcgaucaccgauugguccggcuacucuggauccuuuguccagcauccggaacucacaggccuggacugcauccgcccuuguuucuggguggagcuuguuagagggcugccccgggaaaauaccacgauuuggacauccggaucuagcaucuccuucugcggcguggauagcgacaccgccaacuggucuuggccugauggggcugagcuccccuuuaccauugacaaauga

SEQ ID NO: 199182 - RNA, 1413 nt, Artificial Sequence; identical to SEQ ID NO: 199054
  derived and/or modified sequence opt5 from neuraminidase__InfluenzaA__ABW40051

SEQ ID NO: 199183 - RNA, 1413 nt, Artificial Sequence; identical to SEQ ID NO: 199054
  derived and/or modified sequence opt5 from neuraminidase__InfluenzaA__ABW40062

SEQ ID NO: 199184 - RNA, 1410 nt, Artificial Sequence; identical to SEQ ID NO: 199090
  derived and/or modified sequence opt5 from neuraminidase__InfluenzaA__ABW40084

SEQ ID NO: 199185 - RNA, 1413 nt, Artificial Sequence
  derived and/or modified sequence opt5 from neuraminidase__InfluenzaA__ABW40095
augaaccccaaucagaagaucauuaccaucggcagcauuuccguggccaucgggauuaucucucugaugcuccaaaucggaaacauuaucagcauuugggcuucccacucuauccagacaggcagccagaaucauacggggauuugcaaccagagaaucauuaccuacgagaauagcacaugggucaaccacaccuauguuucuaucaauaacacaaaugugguggccggaaaagacaagaccagcgucacacuggcgggcaacuccagccuuuguucuaucuccgggugggcuauuuacaccaaagauaauagcauccggauuggaucuaagggcgacguguucguuauccgcgaaccuuuuauuuccugcagccaucuggaguguagaacguucuuucucacccaaggcgcccugcuuaacgauaaacacucuaaugggacagugaaggaccgguccccguaucgcgcccugaugagcugcccccucggagaagcuccuucccccuacaacucuaaguucgagagcgucgccugguccgcuagcgccugucaugauggcaugggguggcugaccaucggaaucucuggcccugacaauggggcgguggccguucugaaauauaacggaauuaucacagaaaccauuaaguccuggaaaaagagaauccuccggacgcaggagagcgagugcgugugugucaacggcucuugcuuuacaauuaugaccgauggccccagcaauggggcugccuccuacaaaaucuucaagaucgaaaagggaaaagugacaaagucuauugagcugaacgcuccuaauuuucacuaugaagaguguagcugcuacccggacaccggcaccgugaugugugucugccgcgauaacuggcacggguccaauagacccuggguuagcuucaaccagaaucuugacuaccagaucggauauauuugcucuggcguguuuggggauaacccucggcccaaagacggaaagggcuccuguaauccuaugacaguggauggcgccgacggggucaaaggauucagcuacaaguauggcaacgggguguggaucggacgcacgaaaucuaauagacugcggaagggcuuugagaugauuugggaccccaacggguggaccgauacagacuccgauuucagcguuaagcaagacguggucgcgaucaccgauugguccggcuacucuggauccuuugugcagcauccggaacucacaggccuggacugcauucgcccuuguuucuggguugagcuugugagagggcugccccgggaaaauaccacgaucuggacauccggaucuagcaucuccuucugcggcgucgauagcgacaccgccaacuggucuuggccugauggggcugagcuccccuuuaccauugacaaauga

SEQ ID NO: 199186 - RNA, 1413 nt, Artificial Sequence
  derived and/or modified sequence opt5 from neuraminidase__InfluenzaA__ABW40106
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugucugaacggcucuugcuuuacaaucaugaccgauggccccagcaauggggcugccuccuacaaaaucuucaagauugaaaagggaaaagugacaaagucuaucgagcuuaacgcuccuaauuuucacuaugaagaguguagcugcuacccggacaccggcaccgucaugugugugugccgcgauaacuggcacggguccaauagacccugggugagcuucaaccagaaucuggacuaccagauuggauauaucugcucuggcgucuuuggggauaacccucggcccaaagacggaaagggcuccuguaauccuguuacaguggauggcgccgacggggugaaaggauucagcuacaaguauggcaacggggucuggauuggacgcacgaaaucuaauagacuccggaagggcuuugagauggugugggaccccaacggguggaccgauacagacuccgauuucagcguuaagcaagacguggucgcgaucaccgauugguccggcuacucuggauccuuugugcagcauccggaacugacaggccuugacugcauucgcccuuguuucuggguugagcuggugagagggcucccccgggaaaauaccacgaucuggacauccggaucuagcaucuccuucugcggcgucgauagcgacaccgccaacuggucuuggccugauggggcugagcugcccuuuaccauugacaaauga

SEQ ID NO: 199187 - RNA, 1413 nt, Artificial Sequence; identical to SEQ ID NO: 199054
  derived and/or modified sequence opt5 from neuraminidase__InfluenzaA__ABW40117

SEQ ID NO: 199188 - RNA, 1413 nt, Artificial Sequence; identical to SEQ ID NO: 199054
  derived and/or modified sequence opt5 from neuraminidase__InfluenzaA__ABW40128

SEQ ID NO: 199189 - RNA, 1410 nt, Artificial Sequence; identical to SEQ ID NO: 198908
  derived and/or modified sequence opt5 from neuraminidase__InfluenzaA__ABW40139

SEQ ID NO: 199190 - RNA, 1413 nt, Artificial Sequence; identical to SEQ ID NO: 199054
  derived and/or modified sequence opt5 from neuraminidase__InfluenzaA__ABW40150

SEQ ID NO: 199191 - RNA, 1413 nt, Artificial Sequence; identical to SEQ ID NO: 199054
  derived and/or modified sequence opt5 from neuraminidase__InfluenzaA__ABW40161

SEQ ID NO: 199192 - RNA, 1410 nt, Artificial Sequence
  derived and/or modified sequence opt5 from neuraminidase__InfluenzaA__ABW40172
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaccagaggacgcaaggaggaaaccgaggugcucuggacaucuaacagcaucguuguguucuguggcaccuccgggacauacggaacgggcucuuggcccgacggggcugauauuaaucugaugccuaucuga

SEQ ID NO: 199193 - RNA, 1413 nt, Artificial Sequence; identical to SEQ ID NO: 199054
  derived and/or modified sequence opt5 from neuraminidase__InfluenzaA__ABW40183

SEQ ID NO: 199194 - RNA, 1410 nt, Artificial Sequence; identical to SEQ ID NO: 198908
  derived and/or modified sequence opt5 from neuraminidase__InfluenzaA__ABW40194

SEQ ID NO: 199195 - RNA, 1413 nt, Artificial Sequence; identical to SEQ ID NO: 199089
  derived and/or modified sequence opt5 from neuraminidase__InfluenzaA__ABW40205

SEQ ID NO: 199196 - RNA, 1413 nt, Artificial Sequence; identical to SEQ ID NO: 199093
  derived and/or modified sequence opt5 from neuraminidase__InfluenzaA__ABW40216

SEQ ID NO: 199197 - RNA, 1413 nt, Artificial Sequence; identical to SEQ ID NO: 199093
  derived and/or modified sequence opt5 from neuraminidase__InfluenzaA__ABW40227

SEQ ID NO: 199198 - RNA, 1413 nt, Artificial Sequence; identical to SEQ ID NO: 199054
  derived and/or modified sequence opt5 from neuraminidase__InfluenzaA__ABW40238

SEQ ID NO: 199199 - RNA, 1410 nt, Artificial Sequence
  derived and/or modified sequence opt5 from neuraminidase__InfluenzaA__ABW40249
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaaccauaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggccugacggggcugauaucaaucugaugcccaucuga

SEQ ID NO: 199200 - RNA, 1413 nt, Artificial Sequence; identical to SEQ ID NO: 199054
  derived and/or modified sequence opt5 from neuraminidase__InfluenzaA__ABW40260

SEQ ID NO: 199201 - RNA, 1410 nt, Artificial Sequence
  derived and/or modified sequence opt5 from neuraminidase__InfluenzaA__ABW40271
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugagcaucggaauugguccaagccccagugugacauuaccggguucgccccuuuuucuaaagauaacagcauccgccuguccgcgggaggcgacaucugggugacaagagagcccuacgucucuugcgauccugacaaguguuaucaauucgcucuugggcagggaaccacacugaauaacgugcacagcaaugauaccguucgggaccgcacgccguacagaacacuccugaugaacgaacugggcgugcccuuucaucucgggaccaagcaggucugcauugccugguccucuagcuccugucacgauggaaaagccuggcugcaugugugcaucacaggcgacgauaagaaugcuaccgccagcuucauuuauaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccacaccuccacacugucuggaagcgcgcaacacguugaggaaugcuccugcuacccuagauaucccggcgugcggugugugugccgcgauaacuggaaggggagcaacagaccuauugucgacaucaauauuaaagaccauucuaucguguccagcuacguuuguucuggacuugugggcgauacgccccggaagaacgacagcuccucuagcucccacugccuggauccgaauaacgaggaaggcgggcauggagucaaaggcugggccuucgacgaugggaaugacguguggaugggacgcaccaucagcgagaagucuagacucggcuacgagacauuuaaaguuauugaagggugguccaacccuaagagcaaacugcagaucaaucgccaggugauugucgaucggggaaacagaucuggcuauuccggcaucuucagcguggaggggaaguccuguauuaaucggugcuuuuacgucgaacugaucagaggacgcaaggaggaaaccgaggugcucuggaccucuaacagcauuguuguguucuguggcacauccgggaccuauggaacaggcucuuggcccgacggggcugauaucaaucugaugccuaucuga

SEQ ID NO: 199202 - RNA, 1413 nt, Artificial Sequence; identical to SEQ ID NO: 199054
  derived and/or modified sequence opt5 from neuraminidase__InfluenzaA__ABW40282

SEQ ID NO: 199203 - RNA, 1413 nt, Artificial Sequence; identical to SEQ ID NO: 199089
  derived and/or modified sequence opt5 from neuraminidase__InfluenzaA__ABW40293

SEQ ID NO: 199204 - RNA, 1413 nt, Artificial Sequence; identical to SEQ ID NO: 199054
  derived and/or modified sequence opt5 from neuraminidase__InfluenzaA__ABW40304

SEQ ID NO: 199205 - RNA, 1413 nt, Artificial Sequence; identical to SEQ ID NO: 199054
  derived and/or modified sequence opt5 from neuraminidase__InfluenzaA__ABW40315

SEQ ID NO: 199206 - RNA, 1410 nt, Artificial Sequence; identical to SEQ ID NO: 198908
  derived and/or modified sequence opt5 from neuraminidase__InfluenzaA__ABW40326

SEQ ID NO: 199207 - RNA, 1413 nt, Artificial Sequence; identical to SEQ ID NO: 199095
  derived and/or modified sequence opt5 from neuraminidase__InfluenzaA__ABW40337

SEQ ID NO: 199208 - RNA, 1413 nt, Artificial Sequence; identical to SEQ ID NO: 199089
  derived and/or modified sequence opt5 from neuraminidase__InfluenzaA__ABW40359

SEQ ID NO: 199209 - RNA, 1413 nt, Artificial Sequence
  derived and/or modified sequence opt5 from neuraminidase__InfluenzaA__ABW40370
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgagccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacuccggcaccgugaugugugugugccgcgauaacuggcacgggagcaauagacccugggucucuuucaaccagaaucuugacuaccagauuggauauaucugcuccggcguuuuuggggauaacccucggcccaaagacggaaagggcagcuguaauccugugaccguggauggcgccgacggggucaaaggauucucuuacaaguauggcaacgggguguggauuggacgcacaaaauccaauagacugcggaagggcuuugagaugaucugggaccccaacggguggacggauaccgacagcgauuucuccguuaagcaagacguggucgcgauuacagauuggucuggcuacagcggauccuuugugcagcauccggaacucaccggccuggacugcauccgcccuuguuucuggguugagcuugugagagggcugccccgggaaaauacaaccaucuggacgucuggaagcuccauuagcuucugcggcgucgauucugacacagccaacugguccuggccugauggggcugagcuccccuuuaccaucgacaaauga

SEQ ID NO: 199210 - RNA, 1413 nt, Artificial Sequence; identical to SEQ ID NO: 199054
  derived and/or modified sequence opt5 from neuraminidase__InfluenzaA__ABW40403

SEQ ID NO: 199211 - RNA, 1413 nt, Artificial Sequence
  derived and/or modified sequence opt5 from neuraminidase__InfluenzaA__ABW40414
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucgaccagaaccuugauuaccagauuggauauaucugcucuggcguuuuuggggacaauccucggcccaaagauggaaagggcuccuguaacccugugacaguggacggcgccgacggggucaaaggauucagcuacaaguauggcaaugggguguggauuggacgcacgaaaucuaacagacugcggaagggcuuugagaugaucugggaucccaauggguggaccgacacagauuccgacuucagcguuaagcaagauguggucgcgauuaccgacugguccggcuacucuggauccuuugugcagcauccggaacucacaggccuggauugcauccgcccuuguuucuggguugagcuugugagagggcugccccgggaaaacaccacgaucuggacauccggaucuagcauuuccuucugcggcgucgacagcgauaccgccaauuggucuuggccugacggggcugagcuccccuuuaccaucgauaaauga

SEQ ID NO: 199212 - RNA, 1413 nt, Artificial Sequence; identical to SEQ ID NO: 199054
  derived and/or modified sequence opt5 from neuraminidase__InfluenzaA__ABW40425

SEQ ID NO: 199213 - RNA, 1413 nt, Artificial Sequence; identical to SEQ ID NO: 199095
  derived and/or modified sequence opt5 from neuraminidase__InfluenzaA__ABW40436

SEQ ID NO: 199214 - RNA, 1413 nt, Artificial Sequence
  derived and/or modified sequence opt5 from neuraminidase__InfluenzaA__ABW40447
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacaagcugagaaagggcuuugagaugauuugggaccccaauggguggaccgauacagacucugauuucuccguuaaacaagacguggucgcgaucaccgauuggagcggcuacuccggaucuuuugugcagcauccggaacucacaggccugaacugcauucggccuuguuucuggguugagcuugugcgcgggcugcccagagaaaauaccacgaucuggacaagcggauccucuaucagcuucugcggcgucgacuccgauaccgccaacuggagcuggccugacggggcugagcuccccuuuaccauugauaaguga

SEQ ID NO: 199215 - RNA, 1413 nt, Artificial Sequence; identical to SEQ ID NO: 199080
  derived and/or modified sequence opt5 from neuraminidase__InfluenzaA__ABW40458

SEQ ID NO: 199216 - RNA, 1413 nt, Artificial Sequence; identical to SEQ ID NO: 199054
  derived and/or modified sequence opt5 from neuraminidase__InfluenzaA__ABW40469

SEQ ID NO: 199217 - RNA, 1413 nt, Artificial Sequence; identical to SEQ ID NO: 199054
  derived and/or modified sequence opt5 from neuraminidase__InfluenzaA__ABW40491

SEQ ID NO: 199218 - RNA, 1413 nt, Artificial Sequence; identical to SEQ ID NO: 199054
  derived and/or modified sequence opt5 from neuraminidase__InfluenzaA__ABW40502

SEQ ID NO: 199219 - RNA, 1413 nt, Artificial Sequence; identical to SEQ ID NO: 199095
  derived and/or modified sequence opt5 from neuraminidase__InfluenzaA__ABW40513

SEQ ID NO: 199220 - RNA, 1413 nt, Artificial Sequence; identical to SEQ ID NO: 199054
  derived and/or modified sequence opt5 from neuraminidase__InfluenzaA__ABW40524

SEQ ID NO: 199221 - RNA, 1413 nt, Artificial Sequence
  derived and/or modified sequence opt5 from neuraminidase__InfluenzaA__ABW40546
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccauggagcugaaugcuccuaacuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugacaguggauggcgccgacggggucaaaggauucuccuacaaguauggcaaugggguguggaucggacgcacgaaaagcaacagacugcggaagggcuuugagaugauuugggaccccaauggguggaccgauacagacucugauuucuccguuaagcaagacguggucgcgaucaccgauuggagcggcuacuccggaucuuuugugcagcauccggaacucacaggccuggacugcauucgcccuuguuucuggguugagcuugugagagggcugccccgggaaaacaccacgaucuggacaagcggauccucuaucagcuucugcggcgucgauuccgacaccgccaauuggagcuggccugauggggcugagcuccccuuuaccauugacaaauga

SEQ ID NO: 199222 - RNA, 1413 nt, Artificial Sequence; identical to SEQ ID NO: 199054
  derived and/or modified sequence opt5 from neuraminidase__InfluenzaA__ABW40557

SEQ ID NO: 199223 - RNA, 1413 nt, Artificial Sequence
  derived and/or modified sequence opt5 from neuraminidase__InfluenzaA__ABW40568
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcagauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgggauaacuggcacggguccaaucgccccugggucagcuucaaccagaaucuugacuaccaaauuggauauaucugcucuggcguuuuuggggauaacccuagacccaaagacggaaagggcuccuguaauccugugacaguggauggcgccgacggggucaaaggauucagcuacaaguauggcaacgggguguggauuggacggacgaaaucuaaucgccugagaaagggcuuugagaugaucugggaccccaacggguggaccgauacagacuccgauuucagcguuaagcaggacguggucgcgauuaccgauugguccggcuacucuggauccuuugugcagcauccggaacucacaggccuggacugcauccggccuuguuucuggguugagcuugugcgcgggcugcccagagaaaauaccacgaucuggacauccggaucuagcauuuccuucugcggcgucgauagcgacaccgccaacuggucuuggccugauggggcugagcuccccuuuaccaucgacaaauga

SEQ ID NO: 199224 - RNA, 1413 nt, Artificial Sequence
  derived and/or modified sequence opt5 from neuraminidase__InfluenzaA__ABW40579
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgagccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccaauaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcgauuaccgauuggagcggcuacuccggaucuuuugugcagcauccggaacucacaggccuggacugcauccgcccuuguuucuggguugagcuugugagagggcugccccgggaaaacaccacgaucuggacaagcggauccucuauuagcuucugcggcgucgauuccgacaccgccaauuggagcuggccugauggggcugagcuccccuuuaccaucgacaaauga

SEQ ID NO: 199225 - RNA, 1413 nt, Artificial Sequence
  derived and/or modified sequence opt5 from neuraminidase__InfluenzaA__ABW40601
augaaccccaaucagaagaucauuaccaucggcagcauuuccaucgccauuggggugaucucucugaugcuccaaaucggaaacauuaucagcauuugggcuucccacucuauccagacaggcagccagaaucauacggggauuugcaaccagagaaucauuaccuacgaaaauuccacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgagccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgcgauaauuggcacgggagcaacagacccuggguuuccuucaaucagaaccuugacuaccagaucggauauauuugcagcggcguguuuggggauaauccucggcccaaagacggaaagggcucuuguaacccugugacagucgauggcgccgacgggaucaaaggauucuccuacaaguauggcaaugggguguggauuggacgcacgaaaagcaacagacugcggaagggcuuugagaugaucugggaccccaauggguggaccaacacagauucugacuucuccguuaagcaagauguggucgcgauuaccgacuggagcggcuacuccggaucuuuugugcagcauccggaacucacaggccuggauugcauccgcccuuguuucuggguugagcuugugagagggcugccccgggaaaauaccacgaucuggacaagcggauccucuauuagcuucugcggcgucgacggggauaccgccaacugguccuggccugacggagcugagcuccccuuuaccaucgauaaauga

SEQ ID NO: 199226 - RNA, 1413 nt, Artificial Sequence; identical to SEQ ID NO: 199089
  derived and/or modified sequence opt5 from neuraminidase__InfluenzaA__ABW40612

SEQ ID NO: 199227 - RNA, 1413 nt, Artificial Sequence; identical to SEQ ID NO: 199054
  derived and/or modified sequence opt5 from neuraminidase__InfluenzaA__ABW40623

SEQ ID NO: 199228 - RNA, 1410 nt, Artificial Sequence; identical to SEQ ID NO: 198908
  derived and/or modified sequence opt5 from neuraminidase__InfluenzaA__ABW40634

SEQ ID NO: 199229 - RNA, 1413 nt, Artificial Sequence; identical to SEQ ID NO: 199054
  derived and/or modified sequence opt5 from neuraminidase__InfluenzaA__ABW40645

SEQ ID NO: 199230 - RNA, 1410 nt, Artificial Sequence
  derived and/or modified sequence opt5 from neuraminidase__InfluenzaA__ABW40656
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgggaucugggugacaagagagcccuaugucucuugcgacccugauaaguguuaccaauucgcucuuggacagggcaccacacugaauaacgugcauagcaaugacaccguucgggaucgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuaucguguccuggagcaaagagauucugcgcacccaggaaucugagugugucugcaucaauggaacauguacgguggugaugaccgacggcuccgcuagcgggaaggccgauacaaaaauccucuuuauugaggaaggaaagaucguccauaccuccacacugucuggcagcgcgcaacacguugaggaaugcuccugcuauccuagauaccccggggugcggugugugugccgcgacaacuggaagggaagcaacagaccuauugucgauaucaauauuaaagaccacucuaucguguccagcuacguuuguucuggccuugugggcgacacgccccggaagaacgauagcuccucuagcucccauugccuggacccgaauaacgaggaagggggacacggcgucaaagggugggccuucgaugacggaaaugauguguggaugggccgcaccaucagcgagaagucuagacucggguaugagacauuuaaaguuauugaaggaugguccaacccuaagagcaaacugcagaucaaucgccaggugauugucgaccggggcaacagaucuggcuacuccgggaucuucagcguggagggaaaguccuguauuaaucggugcuuuuaugucgaacugaucagaggccgcaaggaggaaaccgaggugcucuggaccucuaacagcauuguuguguucugugggacauccggaaccuacggcacagggucuuggcccgauggcgcugacaucaaucugaugccuaucuga

SEQ ID NO: 199231 - RNA, 1413 nt, Artificial Sequence; identical to SEQ ID NO: 199095
  derived and/or modified sequence opt5 from neuraminidase__InfluenzaA__ABW40667

SEQ ID NO: 199232 - RNA, 1413 nt, Artificial Sequence; identical to SEQ ID NO: 199080
  derived and/or modified sequence opt5 from neuraminidase__InfluenzaA__ABW40678

SEQ ID NO: 199233 - RNA, 1413 nt, Artificial Sequence; identical to SEQ ID NO: 199089
  derived and/or modified sequence opt5 from neuraminidase__InfluenzaA__ABW71297

SEQ ID NO: 199234 - RNA, 1413 nt, Artificial Sequence; identical to SEQ ID NO: 199095
  derived and/or modified sequence opt5 from neuraminidase__InfluenzaA__ABW71308

SEQ ID NO: 199235 - RNA, 1413 nt, Artificial Sequence; identical to SEQ ID NO: 199054
  derived and/or modified sequence opt5 from neuraminidase__InfluenzaA__ABW71319

SEQ ID NO: 199236 - RNA, 1413 nt, Artificial Sequence; identical to SEQ ID NO: 199054
  derived and/or modified sequence opt5 from neuraminidase__InfluenzaA__ABW71330

SEQ ID NO: 199237 - RNA, 1413 nt, Artificial Sequence
  derived and/or modified sequence opt5 from neuraminidase__InfluenzaA__ABW71341
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggcugggacgcacgaaaucuaauagacuccggaagggcuuugagaugauuugggaccccaacggguggaccgauacagacuccgauuucagcguuaagcaagacguggucgcgaucaccgauugguccggcuacucuggauccuuugugcagcauccggaacugacaggccuugacugcauucgcccuuguuucuggguugagcuggugagagggcucccccgggaaaauaccacgaucuggacauccggaucuagcaucuccuucugcggcgucgauagcgacaccgccaacuggucuuggccugauggggcugagcugcccuuuaccauugacaaauga

SEQ ID NO: 199238 - RNA, 1410 nt, Artificial Sequence; identical to SEQ ID NO: 199081
  derived and/or modified sequence opt5 from neuraminidase__InfluenzaA__ABW71352

SEQ ID NO: 199239 - RNA, 1413 nt, Artificial Sequence; identical to SEQ ID NO: 199095
  derived and/or modified sequence opt5 from neuraminidase__InfluenzaA__ABW71363

SEQ ID NO: 199240 - RNA, 1413 nt, Artificial Sequence; identical to SEQ ID NO: 199080
  derived and/or modified sequence opt5 from neuraminidase__InfluenzaA__ABW71374

SEQ ID NO: 199241 - RNA, 1413 nt, Artificial Sequence; identical to SEQ ID NO: 199054
  derived and/or modified sequence opt5 from neuraminidase__InfluenzaA__ABW71385

SEQ ID NO: 199242 - RNA, 1413 nt, Artificial Sequence
  derived and/or modified sequence opt5 from neuraminidase__InfluenzaA__ABW71396
augaaccccaaucagaagaucauuaccaucggcagcauuuccaucgccauugggaucaucucucugaugcuccaaauuggaaacaucauuagcaucugggcuucccacucugugcagacaggcagccagaaucauacggggauuugcaaccagagaaucauuaccuacgaaaauuccacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgagccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgcgauaauuggcacgggagcaacagacccuggguuuccuucaaucagaaccuugacuaccaggugggauauaucugcagcggcguguuuggggauaauccucggcccaaagacggaaagggcucuuguaacccuaugacagucgauggcgccgacggggugaaaggauucuccuacaaguauggcaaugggguuuggauuggacgcacgaaaagcaacaagcugagaaagggcuuugagaugaucugggaccccaauggguggaccgauacagacucugauuucuccgugaaacaagacgucguggcgauuaccgauuggagcggcuacuccggaucuuuuguucagcauccggaacucacaggccuggacugcauccggccuuguuucuggguggagcuuguccgcgggcugcccagagaaaacgccaccauuuggacgagcggauccucuaucagcuucugcggcguggauuccgacacagcuaauuggagcuggccugauggggccgagcuccccuuuaccaucgacaaguga

SEQ ID NO: 199243 - RNA, 1413 nt, Artificial Sequence
  derived and/or modified sequence opt5 from neuraminidase__InfluenzaA__ABW71407
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacaagauuagaaagggcuuugagaugaucugggaccccaauggguggaccgauacagacucugauuucuccguuaaacaagacguggucgcgauuaccgauuggagcggcuacuccggaucuuuugugcagcauccggaacugacaggccucgacugcauccggccuuguuucuggguugagcuggugcgcgggcuucccagagaaaacaccacgaucuggacaagcggauccucuauuagcuucugcggcgucgauuccgacaccgccaauuggagcuggccugauggggcugagcugcccuuuaccaucgacaaguga

SEQ ID NO: 199244 - RNA, 1413 nt, Artificial Sequence; identical to SEQ ID NO: 199080
  derived and/or modified sequence opt5 from neuraminidase__InfluenzaA__ABW71418

SEQ ID NO: 199245 - RNA, 1413 nt, Artificial Sequence; identical to SEQ ID NO: 199054
  derived and/or modified sequence opt5 from neuraminidase__InfluenzaA__ABW71440

SEQ ID NO: 199246 - RNA, 1413 nt, Artificial Sequence; identical to SEQ ID NO: 199054
  derived and/or modified sequence opt5 from neuraminidase__InfluenzaA__ABW71451

SEQ ID NO: 199247 - RNA, 1413 nt, Artificial Sequence; identical to SEQ ID NO: 199089
  derived and/or modified sequence opt5 from neuraminidase__InfluenzaA__ABW71462

SEQ ID NO: 199248 - RNA, 1410 nt, Artificial Sequence; identical to SEQ ID NO: 197351
  derived and/or modified sequence opt5 from neuraminidase__InfluenzaA__ABW80980

SEQ ID NO: 199249 - RNA, 1410 nt, Artificial Sequence; identical to SEQ ID NO: 197195
  derived and/or modified sequence opt5 from neuraminidase__InfluenzaA__ABW80981

SEQ ID NO: 199250 - RNA, 1413 nt, Artificial Sequence
  derived and/or modified sequence opt5 from neuraminidase__InfluenzaA__ABW81474
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagaaaauuaucaccuaugagaauagaacaugggucaaccaaaccuacguuaauuucaacaauacaaacgugguggccggaaaggacaaaccuuccaugacccuggcgggcaauucuagccuuuguccgauccgggggugggcuauuuauacaaaggauaacuccauccgcauuggaagcaaaggcgacgucuuugugaucagagaacccuucauuucuugcucccaucuggagugucggaccuuuuuccucacgcagggcgcccugcuuaaugauaagcacagcaacgggaccaucaaggaccgcucuccuuuuagagcccugauguccugcccccucggagaagcuccuagccccuacaauucucgguucgaguccguugccuggagcgcuuccgccugucaugauggccugggguggcugacaaucggaauuucuggcccugacaacggggcgguggccguccucaaauauaacggaaucauuaccgaaacaaucaagagcuggaaaaagcagauucugcgcacccaggaguccgagugcguguguguuaauggcagcugcuuuacgaucaugacagauggcccgucuaacagagcugccuccuaccggaucuucaaaauugaaaaggggcgcgugaccaagagcaucgagcuugacgcucccaauuaucacuacgaagaguguucuugcuacccugauacaggaaccgucaugugugugugcagagacaacuggcauggcagcaaucggcccuggguguccuuuaaccaaaaucuggauuaucagauuggguacaucugcucuggagucuucggcgacaacccucgccccaaagauggggagggaagcuguaauccgguuaccguggacggcgccgacggcgugaagggguuuuccuauagauacggaaacggcgucuggauugggcggacaaaaagcaaucgccucagaaagggauucgaaaugaucugggauccuaacggcuggacggacaccgauucugacuuuuccaugaaacaggaugugguugcgaugacagacuggagcggguauucuggcuccuucgugcagcaccccgagcugaccggacuugauugcaugcggccuuguuucugggucgaacuggugagaggccucccccgcgagaauacaaccauuuggacgagcggguccucuaucagcuuuugcggaguuaacuccgaaacagccaauuggucuuggcccgacggcgcugagcugccuuucaccaucgauaaguga

SEQ ID NO: 199251 - RNA, 1413 nt, Artificial Sequence
  derived and/or modified sequence opt5 from neuraminidase__InfluenzaA__ABW81475
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagucuagcgugacccuggcgggcaauuccagccuuuguucuauuuccgggugggcuaucuacacaaaagauaacagcauucggaucggaucuaagggcgacgucuucgugauucgcgaaccuuuuaucuccugcagccaucuggaguguagaaccuucuuucucacgcaaggcgcccugcuuaaugauaaacacucuaacgggaccguuaaggaccgguccccguaucgcgcccugaugagcugcccccucggagaagcuccuucccccuacaauucuaaguucgagagcguggccugguccgcuagcgccugucaugauggcaugggguggcugacaaucggaauuucuggcccugacaacggggcggucgccgugcugaaauauaacggaaucauuaccgaaacaaucaaguccuggaaaaagcggauucucagaacccaggagagcgagugcguuugugugaauggcucuugcuuuacgaucaugacagauggccccagcaacggggcugccuccuacaaaaucuucaagauugaaaagggaaaagucaccaagucuaucgagcugaaugcuccuaacuuucacuaugaagaguguagcugcuacccggacacaggcaccgugaugugugugugccgcgauaauuggcacggguccaacagacccugggucagcuucaaucagaaccuugacuaccagauuggauauaucugcucuggcguuuuuggggauaauccucggcccaaagacggagagggcuccuguaacccugugaccguggauggcgccgacggggucaagggauucagcuacaaauauggcaaugggguguggauuggacgcacaaagucuaacagacugcggaaaggcuuugaaaugaucugggaccccaauggguggacggauaccgacuccgauuucagccucaagcaagacguuguggcgauuacagauugguccggcuacucuggauccuuuguccagcauccggagcugaccggccuugacugcauccgcccuuguuucuggguggaacugguuagagggcucccccgggagaacacaaccaucuggacguccggaucuagcauuuccuucugcggcgugaauagcgauacagccaacuggucuuggccugacggggcugaacugcccuuuaccaucgauaaguga

SEQ ID NO: 199252 - RNA, 1413 nt, Artificial Sequence
  derived and/or modified sequence opt5 from neuraminidase__InfluenzaA__ABW81477
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugucugcuccuaauuuucacuaugaagaguguagcugcuacccggacaccggcaccgugaugugugugugccgggauaacuggcacggguccaaucgccccugggucagcuucaaccagaaucuugacuaccaaauuggauauaucugcucuggcguuuuuggggauaacccuagacccaaagacggagagggcuccuguaauccugugacaguggauggcgccaacggggucaagggauucagcuacaaauauggcaaugggguguggauuggacggacgaagucuaaccgccugagaaaaggcuuugaaaugaucugggaccccaauggguggccggacaccgauuccgacuucagcguuaagcaggauguggucgcgauuacagacugguccggcuacucuggauccuuugugcagcauccugagcucaccggccuggauugcauccggcccuguuucuggguugaacuugugcgcgggcugccuaaggagaacacaaccaucuggacguccggaucuagcauuuccuucugcggcgucaauagcgacacagccaacuggucuuggcccgauggggcugaacuccccuuuaccaucgacaaauga

SEQ ID NO: 199253 - RNA, 1413 nt, Artificial Sequence
  derived and/or modified sequence opt5 from neuraminidase__InfluenzaA__ABW81478
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggagagggcucuuguaacccugugacaguggauggcgccgacggggucaagggauucuccuacaaauauggcaaugggguguggauuggacgcacgaagaacaauagacugcggaaaggcuuugaaaugaucugggaccccaacggguggaccgauacagacagcgauuucucuguuaagcaagacguggucgcgauuaccgauugguccggcuacagcggauccuuugugcagcauccggagcucacaggccuggacugcauccgcccuuguuucuggguugaacuugugagagggcugccccgggagaauaccacgaucuggacaucuggaagcuccauuucuuucugcggcgucaacagcgauaccgccaacugguccuggccugacggggcugaacuccccuuuaccaucgauaaguga

SEQ ID NO: 199254 - RNA, 1413 nt, Artificial Sequence
  derived and/or modified sequence opt5 from neuraminidase__InfluenzaA__ABW81479
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagaaaauuaucaccuaugagaauagaacaugggucaaccaaaccuacguuaauaucaacaauacaaacgugguggccggaaaggacaaaccuuccaugacccuggcgggcaauucuagccuuuguccgauucgggggugggcuaucuauacaaaggauaacuccauucgcaucggaagcaaaggcgacgucuucgugauuagagaacccuuuaucucuugcucccaucuggagugucggaccuucuuucucacgcagggcgcccugcuuaaugauaagcacagcaacgggaccaucaaggaccgcucuccuuucagagcccugauguccugcccccucggagaagcuccuagccccuacaauucucgguuugaguccguugccuggagcgcuuccgccugucaugauggccugggguggcugacaauuggaaucucuggcccugacaacggggcgguggccguccucaaauauaacggaauuaucaccgaaacaauuaagagcuggaaaaagcagauccugcgcacccaggaguccgagugcguguguguuaauggcagcugcuucacgaucaugacagauggcccgucuaacagagcugccuccuaccggauuuuuaaaaucgaaaaggggcgcgugaccaagagcauugagcuugacgcucccaauuaucacuacgaagaguguucuugcuacccugauacaggaaccgucaugugugugugcagagacaacuggcauggcagcaaucggcccuggguguccuucaaccaaaaucuggauuaucagaucggguacauuugcucuggagucuuuggcgacaacccucgccccaaagauggggagggaagcuguaauccgguuaccguggacggcgccgacggcaucaagggguucuccuauagauacggaaacggcguguggauugggcggacaaaaagcaaucgccucagaaagggauuugaaaugaucugggauccuaacggcuggacggacaccgauucugacuucuccaugaaacaggaugucguggcgaugacagacuggagcggguauucuggcuccuuuguucagcaccccgagcugaccggacuugauugcaugcggccuuguuucuggguggaacuggucagaggccucccccgcgagaauacaaccaucuggacgagcggguccucuauuagcuucugcggagugaacuccgaaacagccaauuggucuuggcccgacggcgcugagcugccuuuuaccaucgauaaguga

SEQ ID NO: 199255 - RNA, 1413 nt, Artificial Sequence; identical to SEQ ID NO: 197420
  derived and/or modified sequence opt5 from neuraminidase__InfluenzaA__ABW81480

SEQ ID NO: 199256 - RNA, 1413 nt, Artificial Sequence
  derived and/or modified sequence opt5 from neuraminidase__InfluenzaA__ABW81481
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagaaaauuaucaccuaugagaauagaacaugggucaaccaaaccuacguuaauaucaacaauacaaacgugguggccggaaaggacaaaccuuccaugacccuggcgggcaauucuagccuuuguccgauucgggggugggcuaucuauacaaaggauaacuccauucgcaucggaagcaaaggcgacgucuucgugauuagagaacccuuuaucucuugcucccaucuggagugucggaccuucuuucucacgcagggcgcccugcuuaaugauaagcacagcaacgggaccaucaaggaccgcucuccuuucagagcccugauguccugcccccucggagaagcuccuagccccuacaauucucgguuugaguccguugccuggagcgcuuccgccugucaugauggccugggguggcugacaauuggaaucucuggcccugacaacggggcgguggccguccucaaauauaacggaauuaucaccgaaacaauuaagagcuggaaaaagcagauccugcgcacccaggaguccgagugcguguguguuaauggcagcugcuucacgaucaugacagauggcccgucuaacagagcugccuccuaccggauuuuuaaaaucgaaaaggggcgcgugaccaagagcauugagcuugacgcucccaauuaucacuacgaagaguguucuugcuacccugauacaggaaccgucaugugugugugcagagacaacuggcauggcagcaaucggcccuggguguccuucaaccaaaaucuggauuaucagaucggguacauuugcucuggagucuuuggcgacaacccucgccccaaagauggggagggaagcuguaauccgguuaccguggacggcgccgacggcgugaagggguucuccuauagauacggaaacggcgucuggaucgggcggacaaaaagcaaucgccucagaaagggauuugaaaugauuugggauccuaacggcuggacggacaccgauucugacuucuccaugaaacaggaugugguugcgaugacagacuggagcggguauucuggcuccuuugugcagcaccccgagcugaccggacuugauugcaugcggccuuguuucugggucgaacuggugagaggccucccccgcgagaauacaaccaucuggacgagcggguccucuaucagcuucugcggaguuaacuccgaaacagccaauuggucuuggcccgacggcgcugagcugccuuuuaccauugauaaguga

SEQ ID NO: 199257 - RNA, 1413 nt, Artificial Sequence
  derived and/or modified sequence opt5 from neuraminidase__InfluenzaA__ABW81482
augaaccccaaucagaagaucauuaccaucggcagcauuuccguggccaucgggauuaucucucugauccuccaaauuggaaacaucauuagcaucugggcuucccacucuauucagacaggcagccagaauuacacggggaucugcaaccagaaaauuaucaccuaugagaauagaacaugggucaaccaaaccuacguuaauaucaacaauacaaacgugguggccggaaaggacaaaccuuccaugacccuggcgggcaauucuagccuuuguccgauucgggggugggcuaucuauacaaaggauaacuccauucgcaucggaagcaaaggcgacgucuucgugauuagagaacccuuuaucucuugcucccaucuggagugucggaccuucuuucucacgcagggcgcccugcuuaaugauaagcacagcaacgggaccaucaaggaccgcucuccuuucagagcccugauguccugcccccucggagaagcuccuagccccuacaauucucgguuugaguccguugccuggagcgcuuccgccugucaugauggccugggguggcugacaauuggaaucucuggcccugacaacggggcgguggccguccucaaauauaacggaauuaucaccgaaacaauuaagagcuggaaaaagcagauccugcgcacccaggaguccgagugcguguguguuaauggcagcugcuucacgaucaugacagauggcccgucuaacagagcugccuccuaccggauuuuuaaaaucgaaaaggggcgcgugaccaagagcauugagcuugacgcucccaauuaucacuacgaagaguguucuugcuacccugauacaggaaccgucaugugugugugcagagacaacuggcauggcagcaaucggcccuggguguccuucaaccaaaaucuggauuaucagaucggguacauuugcucuggagucuuuggcgacaacccucgccccaaagauggggagggaagcuguaauccgguuaccguggacggcgccgacggcgugaagggguucuccuauagauacggaaacggcgucuggaucgggcggacaaaaagcaaucgccucagaaagggauuugaaaugauuugggauccuaacggcuggacggacaccgauucugacuucuccaugaaacaggaugugguugcgaugacagacuggagcggguauucuggcuccuuugugcagcaccccgagcugaccggacuugccugcaugcggccuuguuucugggucgaacuggugagaggccucccccgcgagaauacaaccaucuggacgagcggguccucuaucagcuucugcggaguuaacuccgaaacagcuaauuggucuuggcccgauggcgccgagcugccuuuuaccauugacaaguga

SEQ ID NO: 199258 - RNA, 1413 nt, Artificial Sequence; identical to SEQ ID NO: 197410
  derived and/or modified sequence opt5 from neuraminidase__InfluenzaA__ABW81483

SEQ ID NO: 199259 - RNA, 1413 nt, Artificial Sequence
  derived and/or modified sequence opt5 from neuraminidase__InfluenzaA__ABW81484
augaaccccaaucagaagaucauuaccaucggcagcauuuccaucgccauugggaucaucucucugaugcuccaaauuggaaacaucauuagcaucugggcuucccacucuauucagacaggcaaucagaaccauacggggaucugcaaucagagaauuaucaccuacgagaacagcacaugggugaaucacaccuaugucaacaucaauaacacaaauguuguggccggaaaaggcaagaccuccgugacacuggcggggaacucuagccuuuguuccauuagcggaugggcuaucuacaccaaagacaauucuauucggaucggcuccaagggcgaugucuucgugauucgcgaaccuuuuaucagcugcucucaucuggaguguagaacguucuuucucacccaaggggcccugcuuaacgacaaacacuccaauggaacaguuaaggaucggagcccguaucgcgcccugaugucuugcccccucggcgaagcuccuucccccuacaacagcaaguucgaguccguggccuggucugcuagcgccugucaugacgggaugggauggcugaccaucggcauuuccgggccugauaacggagcggucgccgugcugaaauauaauggcaucauuacagaaaccaucaagagcuggaaaaagcggauucucagaacgcaggagucugagugcguuugugugaacggcuccugcuuuacaaucaugaccgacgggcccagcaauggagcugccucuuacaaaaucuucaagauugaaaagggcaaagucacaaagagcaucgagcugaacgcuccuaauuuucacuaugaagaguguuccugcuacccggauaccgggaccgugaugugugugugccgcgacaacuggcacggaucuaauagacccugggucagcuucaaccagaaucuugauuaccagauuggcuauaucugcuccgggguuuuuggagacaacccucggcccaaagauggcaagggcagcuguaauccugugacaguggacggggccgauggagucaaaggcuucucuuacaaguaugggaacggaguguggauuggccgcacgaaauccaauagacugcggaagggguuugagaugaucugggaccccaacggcuggaccgacacagauagcgacuucucuguuaagcaagauguggucgcgauuaccgacugguccggauacagcggcuccuuugugcagcauccggaacucacagggcuggauugcauccgcccuuguuucuggguugagcuugugagaggacugccccgggaaaauaccacgaucuggacaucuggcagcuccauuucuuucugcggggucgacagcgauaccgccaacugguccuggccugacggagcugagcuccccuuuaccaucgauaaauga

SEQ ID NO: 199260 - RNA, 1413 nt, Artificial Sequence
  derived and/or modified sequence opt5 from neuraminidase__InfluenzaA__ABW81487
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcgauuaccgauuggagcggcuacuccggaucuuuuauccagcauccggaacucacaggccuggacugcauccgcccuuguuucuggguggagcuuguuagagggcugccccgggaaaacaccacgauuuggacaagcggauccucuaucagcuucugcggcguggauuccgacaccgccaauuggagcuggccugauggggcugagcuccccuuuaccauugacaaauga

SEQ ID NO: 199261 - RNA, 1413 nt, Artificial Sequence; identical to SEQ ID NO: 197410
  derived and/or modified sequence opt5 from neuraminidase__InfluenzaA__ABW81488

SEQ ID NO: 199262 - RNA, 1413 nt, Artificial Sequence; identical to SEQ ID NO: 197410
  derived and/or modified sequence opt5 from neuraminidase__InfluenzaA__ABW81489

SEQ ID NO: 199263 - RNA, 1413 nt, Artificial Sequence
  derived and/or modified sequence opt5 from neuraminidase__InfluenzaA__ABW81490
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguaaaacguucuuucucacccaaggcgcccugcuuaaugauaagcacagcaacgggacaguuaaggacagaucuccguaucgggcccugauguccugcccccucggagaagcuccuagccccuacaauuccaaauucgagucuguggccuggagcgcuuccgccugucaugauggcaugggguggcugaccaucggaauuagcggcccugacaacggggcggucgccgugcugaaguauaacggaaucauuacagaaaccaucaaaucuuggaagaaacgcauucucagaacgcaggaguccgagugcguuugugugaauggcagcugcuuuacaaucaugaccgauggccccucuaacggggcugccagcuacaagaucuucaagauugaaaaaggaaaggucacaaaauccaucgagcugaaugcuccuaacuuucacuaugaagaguguucuugcuacccggacaccggcaccgugaugugugugugccgggauaauuggcacgggagcaaccgccccugggucuccuucaaucagaaccuugacuaccagauuggauauaucugcagcggcguuuuuggggauaauccuagacccaaggacggaaaaggcucuuguaacccugugacaguggauggcgccgacggggucaagggauucuccuacaaauauggcaaugggguguggauuggacggacgaaguccaaccgccugagaaagggcuuugagaugaucugggaccccaauggguggaccgauacagacucugauuucuccguuaaacaagacguggucgcgauuaccgauuggagcggcuacuccggaucuuuugugcagcauccggaacucacaggccuggacugcauccggccuuguuucuggguugagcuugugcgcgggcugcccagagaaaacaccacgaucuggacaagcggauccucuauuagcuucugcggcgucgauuccgacaccgccaauuggagcuggccugauggggcugagcuccccuuuaccaucgacaaguga

SEQ ID NO: 199264 - RNA, 1413 nt, Artificial Sequence
  derived and/or modified sequence opt5 from neuraminidase__InfluenzaA__ABW81491
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuugggagaaacggauucucagaacgcaggaguccgaaugcguuugugugaauggcagcugcuuuacaaucaugaccgauggccccucuaacggggcugccagcuacaagaucuucaaaauugagaagggaaaggucacaaaauccaucgaacugaaugcuccuaacuuucacuaugaggaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaggacggaaaaggcucuuguaacccugugacaguggauggcgccgacggggucaagggauucuccuacaaauauggcaaugggguguggauuggacgcacgaaguccaacagacugcggaaaggcuuugaaaugaucugggaccccaauggguggaccgauacagacucugauuucuccguuaagcaagacguggucgcgauuaccgauuggagcggcuacuccggaucuuuugugcagcauccggagcucacaggccuggacugcauccgcccuuguuucuggguugaacuugugagagggcugccccgggagaacaccacgaucuggacaagcggauccucuauuagcuucugcggcgucgauuccgacaccgccaauuggagcuggccugauggggcugaacuccccuuuaccaucgacaaguga

SEQ ID NO: 199265 - RNA, 1413 nt, Artificial Sequence
  derived and/or modified sequence opt5 from neuraminidase__InfluenzaA__ABW81492
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacaguggauggcgccgacggggucaaaggauucuccuacaaguauggcaaugggguguggauuggacgcacgaaaagcaacagacugcggaagggcuuugagaugaucugggaccccaauggguggaccgauacagacucugauuucuccguuaagcaagacguggucgcgauuaccgauuggagcggcuacuccggaucuuuugugcagcauccggaacucacaggccuggacugcauccgcccuuguuucuggguugagcuugugagagggcugccccgggaaaacaccacgaucugggccagcggauccucuauuagcuucugcggcgucgauuccgacacagcuaauuggagcuggccugauggggccgagcuccccuuuaccaucgacaaauga

SEQ ID NO: 199266 - RNA, 1413 nt, Artificial Sequence; identical to SEQ ID NO: 197410
  derived and/or modified sequence opt5 from neuraminidase__InfluenzaA__ABW81493

SEQ ID NO: 199267 - RNA, 1413 nt, Artificial Sequence; identical to SEQ ID NO: 197410
  derived and/or modified sequence opt5 from neuraminidase__InfluenzaA__ABW81494

SEQ ID NO: 199268 - RNA, 1413 nt, Artificial Sequence; identical to SEQ ID NO: 197410
  derived and/or modified sequence opt5 from neuraminidase__InfluenzaA__ABW81495

SEQ ID NO: 199269 - RNA, 1413 nt, Artificial Sequence; identical to SEQ ID NO: 199264
  derived and/or modified sequence opt5 from neuraminidase__InfluenzaA__ABW81497

SEQ ID NO: 199270 - RNA, 1413 nt, Artificial Sequence
  derived and/or modified sequence opt5 from neuraminidase__InfluenzaA__ABW81498
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuugggagaaacggauucucagaacgcaggaguccgaaugcguuugugugaauggcagcugcuuuacaaucaugaccgauggccccucuaacggggcugccagcuacaagaucuucaaaauugagaagggaaaggucacaaaauccaucgaacugaaugcuccuaacuuucacuaugaggaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaggacggaaaaggcucuuguaacccugugacagucgauggcgccgacggggugaagggauucuccuacaaauauggcaaugggguuuggaucggacgcacgaaguccaacagacugcggaaaggcuuugaaaugauuugggaccccaauggguggaccgauacagacucugauuucuccgugaagcaagacgucguggcgaucaccgauuggagcggcuacuccggaucuuuuguucagcauccggagcucacaggccuggacugcauucgcccuuguuucuggguggaacuugucagagggcugccccgggagaacaccacgaucuggacaagcggauccucuaucagcuucugcggcguggauuccgacaccgccaauuggagcuggccugauggggcugaacuccccuuuaccauugacaaguga

SEQ ID NO: 199271 - RNA, 1413 nt, Artificial Sequence
  derived and/or modified sequence opt5 from neuraminidase__InfluenzaA__ABW81499
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggacgggacaaaaccucugugacacuggcgggcaauagcucccuuuguagcauuucugggugggcuaucuacaccaaggauaacuccauucgcaucggaagcaaaggcgacgucuucgugauuagagaaccuuuuaucucuugcucccaucuggagugucggacguucuuucucacccaaggcgcccugcuuaaugauaagcacagcaacgggacaguuaaagaccgcucuccguauagagcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaguauaacggaaucauuacagaaaccaucaaaucuuggaagaaacggauucuccgcacgcaggaguccgagugcguuugugugaauggcagcugcuuuacaaucaugaccgauggccccucuaacggggcugccagcuacaagaucuucaaaauugaaaagggaaaggucacaaaauccaucgagcugaaugcuccuaacuuucacuaugaagaguguucuugcuacccggacaccggcaccgugaugugugugugcagagauaauuggcacgggagcaaccggcccugggucuccuucaaucagaaccuugacuaccagauuggauauaucugcagcggcguuuuuggggauaauccucgccccaaggacggaaaaggcucuuguaacccugugacaguggauggcgccgacggggucaagggauucuccuacaaauauggcaaugggguguggauuggaagaacgaaguccaaccggcugcgcaaaggcuuugagaugaucugggaccccaauggguggaccgauacagacucugauuucuccguuaagcaagacguggucgcgauuaccgauuggagcggcuacuccggaucuuuugugcagcauccggaacucacaggccuggacugcaucagaccuuguuucuggguugagcuugugcgggggcugccccgcgaaaacaccacgaucuggacaagcggauccucuauuagcuucugcggcgucgauuccgacaccgccaauuggagcuggccugauggggcugagcuccccuuuaccaucgacaaguga

SEQ ID NO: 199272 - RNA, 1413 nt, Artificial Sequence
  derived and/or modified sequence opt5 from neuraminidase__InfluenzaA__ABW81500
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaagacggaaagggcucuuguaacccugugacagccgauggcgcggacggggugaaaggauucuccuacaaguauggcaauggggucuggauuggacgcacgaaaagcaacagacugcggaagggcuuugagaugaucugggaccccaauggguggaccgauacagacucugauuucuccgugaagcaagacguuguggccauuaccgauuggagcggcuacuccggaucuuuuguccagcauccggaacucacaggccuggacugcauccgcccuuguuucuggguggagcuuguuagagggcugccccgggaaaacaccacgaucuggacaagcggauccucuauuagcuucugcggcguggauuccgacaccgcuaauuggagcuggccugauggggccgagcuccccuuuaccaucgacaaauga

SEQ ID NO: 199273 - RNA, 1413 nt, Artificial Sequence
  derived and/or modified sequence opt5 from neuraminidase__InfluenzaA__ABW81501
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagaaaauuaucaccuacgagaauagcacaugggugaaccacaccuaugucaauaucaacaauacaaacguuguggccggaaaggacaaaaccucugugacacuggcgggcaauagcucccuuuguagcgucucugggugggcuauuuacaccaaggauaacuccaucagaauuggaagcaaaggcgacguguucguuauccgggaaccuuuuauuucuugcucccaucuggagugucgcacguucuuucucacccaaggcgcccugcuuaaugauaagcacagcaacgggacagugaaggacagaucuccguaucgggcccugauguccugcccccucggagaagcuccuagccccuacaauuccaaauucgagucugucgccuggagcgcuuccgccugucaugauggcaugggguggcugaccaucggaaucagcggcccugacaacggggcgguggccguucugaaguauaacggaauuaucacagaaaccauuaaaucuuggaagaaacgcauccucagaacgcaggaguccgagugcgugugugucaauggcagcugcuuuacaauuaugaccgauggccccucuaacggggcugccagcuacaagaucuucaagaucgaaaaaggaaaggugacaaaauccauugagcugaaugcuccuaacuuucacuaugaagaguguucuugcuacccggacaccggcaccgugaugugugucugccgggauaauuggcacgggagcaaccgccccuggguuuccuucaaucagaaccuugacuaccagaucggauauauuugcagcggcguguuuggggauaauccuagacccaaggacggaaaaggcucuuguaacccugugacagucgauggcgccgacggggugaagggauucuccuacaaauauggcaaugggguuuggaucggacggacgaaguccaaccgccugagaaagggcuuugagaugauuugggaccccaauggguggaccgauacagacucugauuucuccgugaaacaagacgucguggcgaucaccgauuggagcggcuacuccggaucuuuuguucagcauccggaacucacaggccuggacugcauucggccuuguuucuggguggagcuuguccgcgggcugcccagagaaaacaccacgaucuggacaagcggauccucuaucagcuucugcggcguggauuccgacaccgccaauuggagcuggccugauggggcugagcuccccuuuaccauugacaaguga

SEQ ID NO: 199274 - RNA, 1413 nt, Artificial Sequence; identical to SEQ ID NO: 199095
  derived and/or modified sequence opt5 from neuraminidase__InfluenzaA__ABW86324

SEQ ID NO: 199275 - RNA, 1413 nt, Artificial Sequence; identical to SEQ ID NO: 199067
  derived and/or modified sequence opt5 from neuraminidase__InfluenzaA__ABW86335

SEQ ID NO: 199276 - RNA, 1413 nt, Artificial Sequence; identical to SEQ ID NO: 199054
  derived and/or modified sequence opt5 from neuraminidase__InfluenzaA__ABW86346

SEQ ID NO: 199277 - RNA, 1413 nt, Artificial Sequence; identical to SEQ ID NO: 199054
  derived and/or modified sequence opt5 from neuraminidase__InfluenzaA__ABW86357

SEQ ID NO: 199278 - RNA, 1413 nt, Artificial Sequence; identical to SEQ ID NO: 199054
  derived and/or modified sequence opt5 from neuraminidase__InfluenzaA__ABW86368

SEQ ID NO: 199279 - RNA, 1413 nt, Artificial Sequence; identical to SEQ ID NO: 199080
  derived and/or modified sequence opt5 from neuraminidase__InfluenzaA__ABW86379

SEQ ID NO: 199280 - RNA, 1413 nt, Artificial Sequence; identical to SEQ ID NO: 199054
  derived and/or modified sequence opt5 from neuraminidase__InfluenzaA__ABW86390

SEQ ID NO: 199281 - RNA, 1413 nt, Artificial Sequence; identical to SEQ ID NO: 199095
  derived and/or modified sequence opt5 from neuraminidase__InfluenzaA__ABW86401

SEQ ID NO: 199282 - RNA, 1413 nt, Artificial Sequence; identical to SEQ ID NO: 199054
  derived and/or modified sequence opt5 from neuraminidase__InfluenzaA__ABW86412

SEQ ID NO: 199283 - RNA, 1413 nt, Artificial Sequence
  derived and/or modified sequence opt5 from neuraminidase__InfluenzaA__ABW86423
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuugcuaucaugacagauggccccucuaacggggccgcuagcuacaaaaucuucaagauugaaaagggaaaagucaccaaguccaucgagcugaaugccccuaacuuucacuaugaagaguguucuugcuacccggacacaggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugaccguggauggcgcggacggggucaaaggauucuccuacaaguauggcaaugggguguggaucggacgcacaaaaagcaacaagcugagaaagggcuuugagaugauuugggaccccaauggguggacggauaccgacucugauuucuccguuaaacaagacguggucgccaucacagauuggagcggcuacuccggaucuuuugugcagcauccggaacucaccggccuggacugcauucggccuuguuucuggguugagcuugugcgcgggcugcccagagaaaacacaaccaucuggacgagcggauccucuaucagcuucugcggcgucgauuccgacacagcuaauuggagcuggccugauggggccgagcuccccuuuaccauugacaaguga

SEQ ID NO: 199284 - RNA, 1413 nt, Artificial Sequence; identical to SEQ ID NO: 199054
  derived and/or modified sequence opt5 from neuraminidase__InfluenzaA__ABW86434

SEQ ID NO: 199285 - RNA, 1413 nt, Artificial Sequence; identical to SEQ ID NO: 199054
  derived and/or modified sequence opt5 from neuraminidase__InfluenzaA__ABW86445

SEQ ID NO: 199286 - RNA, 1413 nt, Artificial Sequence; identical to SEQ ID NO: 199089
  derived and/or modified sequence opt5 from neuraminidase__InfluenzaA__ABW86456

SEQ ID NO: 199287 - RNA, 1413 nt, Artificial Sequence
  derived and/or modified sequence opt5 from neuraminidase__InfluenzaA__ABW86467
augaacaccaaucagaagaucauuacaaucggcagcauuuccaucgccauugggaucaucucucugaugcuccaaauuggaaacaucauuagcaucugggcuucccacucuauucagacgggcagccagaaucauaccgggaucugcaaccagagaauuaucacauacgagaauagcaccugggugaaccacacauaugucucuaucaauaacaccaauguuguggccggaaaagacaagacaagcgugacccuggcgggcaacuccagccuuuguucuauuuccgggugggcuaucuacacgaaagauaauagcauucggaucggaucuaagggcgacgucuucgugauucgcgaacccuuuaucuccugcagccaucuggaguguagaaccuucuuucucacacaaggcgcccugcuuaacgauaaacacucuaaugggaccguuaaggaccgguccccuuaucgcgcccugaugagcugcccgcucggagaagcucccuccccuuacaacucuaaguucgagagcguggccugguccgcuagcgccugucaugauggcaugggguggcugacaaucggaauuucuggccccgacaauggggcggucgccgugcugaaauauaacggaaucauuaccgaaacgaucaaguccuggaaaaagcggauucucagaacacaggagagcgagugcguuugugugaacggcucuugcuuuaccaucaugacagauggcccuagcaauggggcugccuccuacaaaaucuucaagauugaaaagggaaaagucaccaagucuaucgagcugaacgcucccaauuuucacuaugaagaguguagcugcuacccugacaccggcacagugaugugugugugccgcgauaacuggcacggguccaauagaccgugggucagcuucaaccagaaucuugacuaccagauuggauauaucugcucuggcguuuuuggggauaacccccggccuaaagacggaaagggcuccuguaaucccgugacgguggauggcgccgacggggucaaaggauucagcuacaaguauggcaacgggguguggauuggacgcaccaaaucuaauagacugcggaagggcuuugagaugaucugggacccuaacggguggacagauaccgacuccgauuucagcauuaagcaagacguuguggcgaucacagauugguccggcuacucuggauccuuuguccagcaucccgaacucaccggccuggacugcauccgcccguguuucuggguggagcuuguuagagggcugccucgggaaaauacgacaauuuggaccuccggaucuagcaucuccuucugcggcguggauagcgacaccgccaacuggucuuggcccgauggggcugagcucccuuuuacaauugacaaauga

SEQ ID NO: 199288 - RNA, 1413 nt, Artificial Sequence; identical to SEQ ID NO: 199089
  derived and/or modified sequence opt5 from neuraminidase__InfluenzaA__ABW86478

SEQ ID NO: 199289 - RNA, 1413 nt, Artificial Sequence
  derived and/or modified sequence opt5 from neuraminidase__InfluenzaA__ABW86489
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgagccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucggcauuaccgauugguccggauacucuggcagcuuugugcagcauccggaacucacagggcuggacugcauccgcccuuguuucuggguugagcuugugagaggacugccccgggaaaauaccacgaucuggacauccggcucuagcauuuccuucugcggggucgauagcgacaccgcgaacuggucuuggccugauggagccgagcuccccuuuaccaucgacaaauga

SEQ ID NO: 199290 - RNA, 1413 nt, Artificial Sequence
  derived and/or modified sequence opt5 from neuraminidase__InfluenzaA__ABW86500
augaaccccaaucagaagaucaugaccauuggcagcaucuccauugccaucgggauuaucucucugaugcuccaaaucggaaacauuaucagcauuugggcuucccacucuauccagacaggcagccagaaucauacggggauuugcaaccagagaaucauuaccuacgaaaauuccacaugggugaaccacaccuaugucaauaucaacaauacaaacguuguggccggaaaagacaagaccucugugacacuggcgggcaauagcucccuuuguagcaucucugggugggcuauuuacaccaaagauaacuccauccggauuggaagcaagggcgacgucuucgugauccgcgagccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagagaauccuccggacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugacaguggauggcgccgacggggucaaaggauucuccuacaaguauggcaaugggguguggaucggacgcacgaaaagcaacagacugcggaagggcuuugagaugauuugggaccccaauggguggaccaacacagauucugacuucuccaugaagcaagauguuguggcgaucaccgacuggagcggcuacuccggaucuuuuguccagcauccggaacucacaggccuggauugcauucgcccuuguuucuggguggagcuuguuagagggcugccccgggaaaauaccacgaucuggacaagcggauccucuaucagcuucugcggcguggacuccgauaccgccaacuggagcuggccugacggggcugagcuccccuuuaccauugauaaauga

SEQ ID NO: 199291 - RNA, 1413 nt, Artificial Sequence; identical to SEQ ID NO: 199054
  derived and/or modified sequence opt5 from neuraminidase__InfluenzaA__ABW86511

SEQ ID NO: 199292 - RNA, 1413 nt, Artificial Sequence
  derived and/or modified sequence opt5 from neuraminidase__InfluenzaA__ABW86522
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauauuugcagcggcguguuuggggauaauccucggcccaaagacggaaagggcucuuguaacccuaugacaguggauggcgccgacggggucaaaggauucuccuacaaguauggcaaugggguguggaucggacgcacgaaaagcaacaagcugagaaagggcuuugagaugauuugggaccccaauggguggaccgauacagacucugauuucuccguuaaacaagacguggucgcggugaccgauuggagcggcuacuccggaucuuuuguucagcauccggaacucacaggccuggacugcauccggccuuguuucuggguggagcuuguccgcgggcugcccagagaaaacgccaccauuuggacgagcggauccucuaucagcuucugcggcguggauuccgacacagcuaauuggagcuggccugauggggccgagcuccccuuuaccaucgacaaguga

SEQ ID NO: 199293 - RNA, 1413 nt, Artificial Sequence; identical to SEQ ID NO: 199054
  derived and/or modified sequence opt5 from neuraminidase__InfluenzaA__ABW86533

SEQ ID NO: 199294 - RNA, 1413 nt, Artificial Sequence; identical to SEQ ID NO: 199089
  derived and/or modified sequence opt5 from neuraminidase__InfluenzaA__ABW86544

SEQ ID NO: 199295 - RNA, 1413 nt, Artificial Sequence; identical to SEQ ID NO: 199054
  derived and/or modified sequence opt5 from neuraminidase__InfluenzaA__ABW86555

SEQ ID NO: 199296 - RNA, 1410 nt, Artificial Sequence
  derived and/or modified sequence opt5 from neuraminidase__InfluenzaA__ABW86566
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccgugaucgagagaaauauuacagaaaucguguaucugaccaacacgaccauugagaaggaaaucugcccuaaacucgcugaguaccggaauugguccaagccccagugugacauuacaggguucgccccuuuuucuaaagauaacagcauccgccuguccgcgggaggcgacauuugggucaccagagagcccuaugugucuugcgauccugacaaguguuaccaauucgcucuugggcagggaacaacccugaauaacguucauagcaaugauacggugcgggaccgcacaccguauagaacccuccugaugaacgaacugggcguccccuuucaccucgggacaaaacaggugugcaucgccugguccucuagcuccugucaugauggaaaggccuggcugcacguuugcaucaccggcgacgauaagaaugcuaccgccagcuucauuuacaacggccggcuuguggacucuaucgucuccuggagcaaagagauucugcgcacacaggaaucugagugugugugcaucaaugggacguguaccguggucaugacagauggauccgcuagcggcaaggccgacaccaaaauucucuuuaucgaggaagggaagaucguucauacauccacccugucuggaagcgcgcaacacguggaggaaugcuccugcuauccuagauaccccggcgugcggugugucugccgcgauaacuggaaggggagcaacagaccuauuguggacaucaauauuaaagaccacucuaucguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcacaauuagcgagaagucuagacucggcuaugagaccuuuaaagugaucgaagggugguccaacccuaagagcaaacugcagaucaaucggcaggucauuguggaucgcggaaacagaucuggcuacuccggcaucuucagcgucgaggggaaguccuguauuaaucggugcuuuuauguggaacugaucagaggacgcaaggaggaaaccgagguucucuggacaucuaacagcauuguggucuucuguggcaccuccgggacauacggaacgggcucuuggcccgacggggcugauaucaaucugaugccuauuuga

SEQ ID NO: 199297 - RNA, 1413 nt, Artificial Sequence; identical to SEQ ID NO: 199080
  derived and/or modified sequence opt5 from neuraminidase__InfluenzaA__ABW86609

SEQ ID NO: 199298 - RNA, 1413 nt, Artificial Sequence; identical to SEQ ID NO: 198083
  derived and/or modified sequence opt5 from neuraminidase__InfluenzaA__ABW91188

SEQ ID NO: 199299 - RNA, 1410 nt, Artificial Sequence
  derived and/or modified sequence opt5 from neuraminidase__InfluenzaA__ABW91210
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuauucuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauccgccuguccgcgggaggcgacauuugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcaucgccugguccucuagcuccugucaugauggaaaagccuggcugcacgugugcauuacaggcgacgauaagaaugcuaccgccagcuucaucuacaacggccggcuuguugacucuauuguguccuggagcaaagagauccugcgcacccaggaaucugagugugucugcaucaaugggacauguacgguggugaugaccgauggauccgcuagcggcaaggccgacacaaaaauucucuuuaucgaggaagggaagauuguccauaccuccacacugucuggaagcgcgcaacacguugaggaaugcuccugcuauccuagauaccccggcgugcggugugugugccgcgauaacuggaaggggagcaacagaccuaucgucgacauuaauaucaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccauuagcgagaagucuagacucggcuaugagacauuuaaaguuaucgaagggugguccaacccuaagagcaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggaccucuaacagcaucguuguguucuguggcacauccgggaccuacggaacaggcucuuggcccgacggggcugauaucaaucugaugccuauuuga

SEQ ID NO: 199300 - RNA, 1413 nt, Artificial Sequence; identical to SEQ ID NO: 199054
  derived and/or modified sequence opt5 from neuraminidase__InfluenzaA__ABW91221

SEQ ID NO: 199301 - RNA, 1410 nt, Artificial Sequence
  derived and/or modified sequence opt5 from neuraminidase__InfluenzaA__ABW91232
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaauccacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaaugauaccguucgggaccgcacgccuuauagaacacuccugaugaacgaacugggcgugccguuucaccucgggaccaagcaggucugcauugccuggagcagcuccagcugucaugauggaaaagccuggcugcacgugugcaucacaggcgacgauaagaaugcuaccgccucuuucauuuacaacggccggcuuguugacuccaucgugagcuggucuaaagagauucugcgcacccaggaauccgagugugucugcaucaaugggacauguacgguggugaugaccgauggaagcgcuuccggcaaggccgacacaaaaauccucuuuauugaggaagggaagaucguccauaccucuacacugagcggauccgcgcaacacguugaggaaugcagcugcuaucccagauacccuggcgugcggugugugugccgcgauaacuggaaggggucuaacagacccauugucgacaucaauauuaaagaccacuccaucgugagcucuuacguuuguagcggacuugugggcgauaccccucggaagaacgacuccucuagcuccggccauugccuggaucccaauaacgaggaagggggacacggcgucaaagggugggccuucgacgauggaaaugacguguggaugggccgcacgaucagcgagaagucuagacucggguaugagacauuuaaaguuauugaaggaugguccaacccgaagucuaaacugcagaucaaucgccaggugauugucgaucggggcaacagaucuggcuacuccgggaucuucagcguggagggaaaguccuguauuaaucggugcuuuuaugucgaacugaucagaggccgcaaggaggaaaccgaggugcucuggaccucuaacagcauuguuguguucugugggacauccggaaccuacggcacagggucuuggccugacggcgcugauaucaaucugaugcccaucuga

SEQ ID NO: 199302 - RNA, 1410 nt, Artificial Sequence; identical to SEQ ID NO: 199090
  derived and/or modified sequence opt5 from neuraminidase__InfluenzaA__ABW91243

SEQ ID NO: 199303 - RNA, 1410 nt, Artificial Sequence; identical to SEQ ID NO: 198908
  derived and/or modified sequence opt5 from neuraminidase__InfluenzaA__ABW91254

SEQ ID NO: 199304 - RNA, 1410 nt, Artificial Sequence; identical to SEQ ID NO: 198908
  derived and/or modified sequence opt5 from neuraminidase__InfluenzaA__ABW91265

SEQ ID NO: 199305 - RNA, 1413 nt, Artificial Sequence; identical to SEQ ID NO: 199054
  derived and/or modified sequence opt5 from neuraminidase__InfluenzaA__ABW91276

SEQ ID NO: 199306 - RNA, 1413 nt, Artificial Sequence
  derived and/or modified sequence opt5 from neuraminidase__InfluenzaA__ABW91287
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacaucuucgucauccgcgagccuuuuauuucuugcucccaccuggaauguagaacguucuuucucacccaaggcgcccugcuuaacgauaaacauagcaauggcacagugaaggaccggucuccguaucgcgcccugauguccugcccccucggggaggcuccuagccccuacaacuccagauucgaaucuguugccuggagcgcuuccgccugucacgauggaaugggcuggcugaccaucgggauuagcggaccugacaacggcgcgguggccguccugaaguauaaugggaucauuacagagaccaucaaaucuuggaagaaacggauccuccgcacgcaggaguccgaaugcguguguaugaacggaagcugcuuuacaauuaugaccgauggccccucuaauggcgcugccagcuacaagaucuucaaaauugagaaggggaagguuacaaaaaccaucgaacugaacgcuccuaauuuucauuaugaggaguguuccugcuacccggacaccggaacagugaugugugucugcagagauaacuggcacggcucuaaucggcccugggugagcuucaaccagaaucuugacuaccagauuggguauaucugcuccggaguguuuggcgauaacccucgccccaaggacggggaaggaagcuguaauccugucacgguugauggcgccgacggcgugaaaggguucucuuacaaguauggaaacggcguguggauugggagaaccaaauccaaucggcugcgcaagggauuugagaugaucugggaccccaacggcuggacaaauaccgauagcgacuucucugucaaacaagauaucguggcgauuacagacugguccggguacagcggcuccuuuguucagcacccggaacucaccggacuggauugcaucagaccuuguuucuggguggagcuuguccggggccugccccgcgaaaacacgacaauuuggaccucugggagcuccaucucuuucugcggagugaacagcggcaccgccaauugguccuggccugacggggcugagcuccccuuuacaauugauaaguga

SEQ ID NO: 199307 - RNA, 1413 nt, Artificial Sequence; identical to SEQ ID NO: 199054
  derived and/or modified sequence opt5 from neuraminidase__InfluenzaA__ABW91298

SEQ ID NO: 199308 - RNA, 1413 nt, Artificial Sequence
  derived and/or modified sequence opt5 from neuraminidase__InfluenzaA__ABW91309
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcgacggggcugccuccuacaaaaucuucaagauugaaaagggaaaagucacaaagucuaucgagcugaaugcuccuaacuuucacuaugaagaguguagcugcuacccggauaccggcaccgugaugugugugugccgcgacaauuggcacggguccaacagacccugggucagcuucaaucagaaccuugauuaccagauuggauauaucugcucuggcguuuuuggggacaauccucggcccaaagauggaaagggcuccuguaacccugugacagccgacggcgcggacggggugaaaggauucagcuacaaguauggcaauggggucuggauuggacgcacgaaaucuaacagacugcggaagggcuuugagaugaucugggaucccaauggguggaccgacacagauuccgacuucagcgugaagcaagauguuguggccauuaccgacugguccggcuacucuggauccuuuguccagcauccggaacucacaggccuggauugcauccgcccuuguuucuggguggagcuuguuagagggcugccccgggaaaacaccacgaucuggacauccggaucuagcauuuccuucugcggcguggacagcgauaccgcuaauuggucuuggccugacggggccgagcuccccuuuaccaucgauaaauga

SEQ ID NO: 199309 - RNA, 1413 nt, Artificial Sequence; identical to SEQ ID NO: 199054
  derived and/or modified sequence opt5 from neuraminidase__InfluenzaA__ABW91320

SEQ ID NO: 199310 - RNA, 1413 nt, Artificial Sequence; identical to SEQ ID NO: 199054
  derived and/or modified sequence opt5 from neuraminidase__InfluenzaA__ABW91331

SEQ ID NO: 199311 - RNA, 1413 nt, Artificial Sequence; identical to SEQ ID NO: 199054
  derived and/or modified sequence opt5 from neuraminidase__InfluenzaA__ABW91342

SEQ ID NO: 199312 - RNA, 1413 nt, Artificial Sequence; identical to SEQ ID NO: 199054
  derived and/or modified sequence opt5 from neuraminidase__InfluenzaA__ABW91353

SEQ ID NO: 199313 - RNA, 1413 nt, Artificial Sequence
  derived and/or modified sequence opt5 from neuraminidase__InfluenzaA__ABW91364
augaacaccaaucagaagaucauuacaaucggcagcauuuccaucgccauugggaucaucucucugaugcuccaaauuggaaacaucauuagcaucugggcuucccacucuauucagacgggcagccagaaucauaccgggaucugcaaccagagaauuaucacauacgaaaauuccaccugggugaaccacacauaugucaauaucaacaauaccaacguugugacaggaaaagacaagaccucugugacgcuggccggcaauagcucccuuuguagcauuucugggugggcgaucuacaccaaagauaacuccauucggaucggaagcaagggcgacgucuucgugauucgcgagcccuuuaucucuugcucccaucuggaguguagaacauucuuucucacccaaggcgcucugcuuaaugauaaacacagcaacgggacaguuaaggaccggucuccuuaucgcgcccugauguccugcccgcucggagaagcccccagcccuuacaauuccaaguucgagucuguggcuuggagcgccuccgcuugucaugauggcaugggguggcugaccaucggaauuagcggccccgacaacggggccgucgcggugcugaaauauaacggaaucauuacggaaacaaucaagucuuggaaaaagcggauucucagaacccaggaguccgagugcguuugugugaauggcagcugcuuuacaaucaugaccgauggcccuucugacggggccgcuagcuacaaaaucuucaagauugaaaagggaaaagucaccaaguccaucgagcugaacgcccccaauuuucacuaugaagaguguucuugcuacccugauacaggcacggugaugugugugugccgcgacaacuggcacgggagcaauagaccgugggucuccuucaaccagaaucuugauuaccagauuggauauaucugcagcggcguuuuuggggacaacccccggccuaaagauggaaagggcucuuguaaucccgugaccguggacggcgcugacggggucaaaggauucuccuacaaguauggcaacgggguguggauuggacgcacaaaaagcaauaagcugagaaagggcuuugagaugaucugggauccuaacggguggaccgacacagauaaugacuucucuguuaaacaagauguggucgccauuaccgacugguccggcuacagcggauccuuugugcagcaucccgaacucacgggccuggauugcauccggccguguuucuggguugagcuugugcgcgggcugccuagagaaaacacaaccaucuggaccucuggaagcuccauuucuuucugcggcgucgacagcgauacagcgaauugguccuggcccgacggggccgagcucccuuuuaccaucgauaaguga

SEQ ID NO: 199314 - RNA, 1413 nt, Artificial Sequence; identical to SEQ ID NO: 199054
  derived and/or modified sequence opt5 from neuraminidase__InfluenzaA__ABW91375

SEQ ID NO: 199315 - RNA, 1413 nt, Artificial Sequence; identical to SEQ ID NO: 199080
  derived and/or modified sequence opt5 from neuraminidase__InfluenzaA__ABW91386

SEQ ID NO: 199316 - RNA, 1410 nt, Artificial Sequence
  derived and/or modified sequence opt5 from neuraminidase__InfluenzaA__ABW91397
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugaguguaucugcaucaaugggacauguacggucgugaugaccgauggauccgcuagcggcaaggccgacacaaaaauucucuuuaucgaggaagggaagauugugcauaccuccacacugucuggaagcgcgcaacacgucgaggaaugcuccugcuauccuagauaccccggcguucggugugugugccgcgauaacuggaaggggagcaacagaccuaucguggacauuaauaucaaagaccacucuaucgucuccagcuacguguguucuggacuuguuggcgauacgccccggaagaacgacagcuccucuagcucccauugccuggauccgaauaacgaggaaggcgggcacggagugaaaggcugggccuucgacgaugggaaugacgucuggaugggacgcaccauuagcgagaagucuagacucggcuaugagacauuuaaagugaucgaagggugguccaacccuaagagcaaacugcagauuaaucggcagguuaucguggaucgcggaaacagaucuggcuacuccggcauuuucagcgucgaggggaaguccuguaucaaucggugcuuuuauguggaacugauuagaggacgcaaggaggaaaccgagguccucuggaccucuaacagcaucgugguuuucuguggcacauccgggaccuacggaacaggcucuuggcccgacggggcugauaucaaucugaugccuauuuga

SEQ ID NO: 199317 - RNA, 1413 nt, Artificial Sequence; identical to SEQ ID NO: 199225
  derived and/or modified sequence opt5 from neuraminidase__InfluenzaA__ABW91408

SEQ ID NO: 199318 - RNA, 1413 nt, Artificial Sequence
  derived and/or modified sequence opt5 from neuraminidase__InfluenzaA__ABW91419
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccgagaaagacaagaccucugugacacuggcgggaaauagcucccuuuguagcauuucuggcugggcuaucuacaccaaagauaacuccauucggaucgggagcaagggagacgucuucgugauucgcgagccuuuuaucucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggauuagcggaccugacaacggcgcggucgccgugcugaaauauaacgggaucauuacagagaccaucaagucuuggaaaaagcggauucucagaacgcaggaguccgaaugcguuugugugaauggaagcugcuuuacaaucaugaccgauggccccucuaacggcgcugccagcuacaaaaucuucaagauugagaaggggaaagucacaaaguccaucgaacugaaugcuccuaacuuucacuaugaggaguguucuugcuacccggacaccggaaccgugaugugugugugccgcgauaauuggcacggcagcaacagacccugggucuccuucaaucagaaccuugacuaccagguuggguauauuugcagcggaguguuuggcgauaauccucggcccaaagacgggaagggaucuuguaacccuaugacaguggauggcgccgacggcgucaaaggguucuccuacaaguauggaaauggcguguggaucgggcgcacgaaaagcaacaagcugagaaagggauuugaaaugauuugggaccccaauggcuggaccgauacagacucugauuucuccguuaaacaagacguggucgcgaucaccgauuggagcggguacuccggcucuuuugugcagcauccggagcucacaggacuggacugcauucggccuuguuucuggguugaacuugugcgcggccugcccagagagaacaccacgaucuggacaagcggguccucuaucagcuucugcggagucgauuccgacaccgccaauuggagcuggccugauggcgcugaacuccccuuuaccauugacaaguga

SEQ ID NO: 199319 - RNA, 1413 nt, Artificial Sequence
  derived and/or modified sequence opt5 from neuraminidase__InfluenzaA__ABW91430
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacgggucugucgcggugcugaaauauaacggaaucauuacagaaaccaucaaguccuggaaaaagcggauucucagaacgcaggagagcgagugcguuugugugaauggcucuugcuuuacaaucaugaccgauggccccagcaacggggccgcuuccuacaaaaucuucaagauugaaaagggaaaagucacaaagucuaucgagcugaaugccccuaacuuucacuaugaagaguguagcugcuacccggacaccggcaccgugaugugugugugccgcgauaauuggcacggguccaacagacccugggucagcuucaaucagaaccuugacuaccagguuggauauauuugcucuggcguguuuggggauaauccucggcccaaagacggaaagggcuccuguaacccuaugacaguggauggcgcugacggggucaaaggauucagcuacaaguauggcaaugggguguggaucggacgcacgaaaucuaacaagcugagaaagggcuuugagaugauuugggaccccaauggguggaccgauacagacuccgauuucagcguuaaacaagacguggucgccaucaccgauugguccggcuacucuggauccuuugugcagcauccggaacucacaggccuggacugcauucggccuuguuucuggguugagcuugugcgcgggcugcccagagaaaacaccacgaucuggacauccggaucuagcaucuccuucugcggcgucgauagcgacaccgcgaauuggucuuggccugauggggccgagcuccccuuuaccauugacaaguga

SEQ ID NO: 199320 - RNA, 1410 nt, Artificial Sequence; identical to SEQ ID NO: 198908
  derived and/or modified sequence opt5 from neuraminidase__InfluenzaA__ABW91441

SEQ ID NO: 199321 - RNA, 1413 nt, Artificial Sequence; identical to SEQ ID NO: 199095
  derived and/or modified sequence opt5 from neuraminidase__InfluenzaA__ABW91452

SEQ ID NO: 199322 - RNA, 1413 nt, Artificial Sequence; identical to SEQ ID NO: 199095
  derived and/or modified sequence opt5 from neuraminidase__InfluenzaA__ABW91463

SEQ ID NO: 199323 - RNA, 1413 nt, Artificial Sequence; identical to SEQ ID NO: 199054
  derived and/or modified sequence opt5 from neuraminidase__InfluenzaA__ABW91474

SEQ ID NO: 199324 - RNA, 1413 nt, Artificial Sequence; identical to SEQ ID NO: 199095
  derived and/or modified sequence opt5 from neuraminidase__InfluenzaA__ABW91485

SEQ ID NO: 199325 - RNA, 1413 nt, Artificial Sequence; identical to SEQ ID NO: 199054
  derived and/or modified sequence opt5 from neuraminidase__InfluenzaA__ABW91496

SEQ ID NO: 199326 - RNA, 1413 nt, Artificial Sequence; identical to SEQ ID NO: 199080
  derived and/or modified sequence opt5 from neuraminidase__InfluenzaA__ABW91507

SEQ ID NO: 199327 - RNA, 1413 nt, Artificial Sequence; identical to SEQ ID NO: 199095
  derived and/or modified sequence opt5 from neuraminidase__InfluenzaA__ABW91518

SEQ ID NO: 199328 - RNA, 1413 nt, Artificial Sequence
  derived and/or modified sequence opt5 from neuraminidase__InfluenzaA__ABW91529
augaaccccaaucagaagaucauuaccaucggcagcauuuccaucgccauugggacaaucucucugaugcuccaaaucggaaacauuaucagcauuugggcuucccacucuauccagacgggcagccagaaucauaccgggauuugcaaccagagaaucauuacauacgagaauagcaccugggugaaccacacauaugucucuaucaauaacaccaauguuguggccggaaaagacaagacaagcgugacccuggcgggcaacuccagccuuuguucuaucuccgggugggcuauuuacacgaaagauaauagcauccggauuggaucuaagggcgacgucuucgugauccgcgaaccuuuuauuuccugcagccaucuggaguguagaaccuucuuucucacacaaggcgcccugcuuaacgauaaacacucuaaugggaccaucaaggaccgguccccguaucgcgcccugaugagcugcccccucggagaagcuccuucccccuacaacucuaaguucgagagcguugccugguccgcuagcgccugucaugauggcaugggguggcugacaaucggaauuucuggcccugacaauggggcgguggccguccugaaauauaacggaaucauuaccgaaacgaucaaguccuggaaaaagcggauucucagaacacaggagagcgagugcguguguguuaacggcucuugcuuuaccaucaugacagauggccccagcaauggggcugccuccuacaaaaucuucaagauugaaaagggaaaagugaccaagucuaucgagcugaacgcuccuaauuuucacuaugaagaguguagcugcuacccggacaccggcacagucaugugugugugccgcgauaacuggcacggguccaauagacccugggugagcuucaaccagaaucuugacuaccagauuggauauaucugcucuggcgucuuuggggauaacccucggcccaaagacggaaagggcuccuguaauccuguuacgguggauggcgccgacggggugaaaggauucagcuacaaguauggcaacggggucuggauuggacgcaccaaaucuaauagacugcggaagggcuuugagaugaucugggaccccaacggguggacagauaccgacuccgauuucagcgugaagcaagacguuguggcgauuacagauugguccggcuacucuggauccuuuguccagcauccggaacucaccggccuggacugcauccgcccuuguuucuggguggagcuuguuagagggcugccccgggaaaauacgacaaucuggaccuccggaucuagcauuuccuucugcggcguggauagcgacaccgccaacuggucuuggccugauggggcugagcuccccuuuacaaucgacaaauga

SEQ ID NO: 199329 - RNA, 1413 nt, Artificial Sequence
  derived and/or modified sequence opt5 from neuraminidase__InfluenzaA__ABW91540
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacauggaugaaccacaccuaugugucuaucaauaacacaaaugucguugccggaaaagacaagaccagcgugacacuggcgggcaacuccagccuuuguucuauuuccgggugggcuaucuacaccaaagauaauagcauucggaucggaucuaagggcgacguguucgucauucgcgaaccuuuuaucuccugcagccaucuggaguguagaacguucuuucucacccaaggcgcccugcuuaacgauaaacacucuaaugggacagugaaggaccgguccccguaucgcgcccugaugagcugcccccucggagaagcuccuucccccuacaacucuaaguucgagagcguugccugguccgcuagcgccugucaugauggcaugggguggcugaccaucggaauuucuggcccugacaauggggcgguggccguccugaaauauaacggaaucauuacagaaaccaucaaguccuggaaaaagcggauucucagaacgcaggagagcgagugcguguguguuaacggcucuugcuuuacaaucaugaccgauggccccagcaauggggcugccuccuacaaaaucuucaagauugaaaagggaaaagugacaaagucugucgagcugaacgcuccuaauuuucacuaugaagaguguagcugcuacccggacaccggcaccgugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacaguggauggcgccgacggggucaaaggauucagcuacaaguauggcaacgggguguggaucggacgcacgaaaucuaauagacugcggaagggcuuugagaugauuugggaccccaacggguggaccgauacagacuccgauuucagcguuaagcaagacguggucgcgaucaccgauugguccggcuacucuggauccuuugugcagcauccggaacucacaggccuggacugcauucgcccuuguuucuggguugagcuugugagagggcugccccgggaaaauaccacgaucuggacauccggaucuagcaucuccuucugcggcgucgauagcgacaccgccaacuggucuuggccugauggggcugagcuccccuuuaccauugacaaauga

SEQ ID NO: 199330 - RNA, 1410 nt, Artificial Sequence
  derived and/or modified sequence opt5 from neuraminidase__InfluenzaA__ABW91551
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaaugauaccguucgggaccgcacgccguauagaacacuccugaugaacgaacugggcgugcccuuccaccucgggaccaagcaggucugcauugccuggagcuccagcucuugucaugauggaaaagccuggcugcacgugugcaucacaggcgacgauaagaaugcuaccgccuccuuuauuuacaacggccggcuuguugacagcaucgugucuugguccaaagagauucugcgcacccaggaaagcgagugugucugcaucaaugggacauguacgguggugaugaccgauggaucugcuuccggcaaggccgacacaaaaauccucuucauugaggaagggaagaucguccauaccagcacacuguccggaucugcgcaacacguugaggaaugcagcugcuauccuagauaccccggcgugcggugugugugccgcgauaacuggaagggguccaacagaccuauugucgacaucaauauuaaagaccacagcaucgugucuuccuacguuuguagcggacuugugggcgauacgccccggaagaacgacucuagcuccucuagccauugccuggauccgaauaacgaggaaggcgggcacggagucaaaggcugggccuuugacgaugggaaugacguguggaugggacgcaccaucuccgaaaagagcagacucggcuaugagacauucaaaguuauugagggguggucuaacccuaaguccaaacugcagaucaaucgccaggugauugucgaucggggaaacagaagcggcuacucuggcaucuuuuccguggagggaaagagcuguauuaaucggugcuucuaugucgaacugaucagagggcgcaaggaggaaaccgaggugcucuggaccuccaacucuauuguuguguucuguggcacaagcgggaccuacggaacaggcuccuggcccgacggggcugauaucaaucugaugccuaucuga

SEQ ID NO: 199331 - RNA, 1413 nt, Artificial Sequence; identical to SEQ ID NO: 199054
  derived and/or modified sequence opt5 from neuraminidase__InfluenzaA__ABW91562

SEQ ID NO: 199332 - RNA, 1413 nt, Artificial Sequence; identical to SEQ ID NO: 199089
  derived and/or modified sequence opt5 from neuraminidase__InfluenzaA__ABW91584

SEQ ID NO: 199333 - RNA, 1413 nt, Artificial Sequence; identical to SEQ ID NO: 199054
  derived and/or modified sequence opt5 from neuraminidase__InfluenzaA__ABW91595

SEQ ID NO: 199334 - RNA, 1413 nt, Artificial Sequence; identical to SEQ ID NO: 199095
  derived and/or modified sequence opt5 from neuraminidase__InfluenzaA__ABW91606

SEQ ID NO: 199335 - RNA, 1413 nt, Artificial Sequence; identical to SEQ ID NO: 199089
  derived and/or modified sequence opt5 from neuraminidase__InfluenzaA__ABW91617

SEQ ID NO: 199336 - RNA, 1413 nt, Artificial Sequence; identical to SEQ ID NO: 199054
  derived and/or modified sequence opt5 from neuraminidase__InfluenzaA__ABW91628

SEQ ID NO: 199337 - RNA, 1413 nt, Artificial Sequence; identical to SEQ ID NO: 199054
  derived and/or modified sequence opt5 from neuraminidase__InfluenzaA__ABW91639

SEQ ID NO: 199338 - RNA, 1410 nt, Artificial Sequence; identical to SEQ ID NO: 198908
  derived and/or modified sequence opt5 from neuraminidase__InfluenzaA__ABW91650

SEQ ID NO: 199339 - RNA, 1350 nt, Artificial Sequence
  derived and/or modified sequence opt5 from neuraminidase__InfluenzaA__ABX10517
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaauuuccuuacagaaaaagcuguggccagcgugaagcuggcggggaacuccucucucuguccgaucaauggaugggcuguccauagcaaagacaacuccauuagaaucggcagcaagggggauguguuuguuauucgggagcccuucaucucuugcucccaccuggaaugucgcaccuuuuuccuuacacagggagcccugcucaaugacaagcauagcaacggcaccgugaaagauagaucuccucaccggacacugauguccugccccgucggcgaggccccuagccccuacaauucucgcuuugaauccguggcuuggagcgccuccgcuugucacgacgggaccucuuggcugacgauuggaaucagcggcccugauaacggggccguugcggugcucaaguauaauggaaucauuaccgacacaaucaaauccuggagaaacaauauucugcggacccaggagagcgagugcgccugugucaacggcucuugcuucacagugaugaccgaugggccguccaacggacaggcuagccauaagaucuuuaaaauggaaaagggcaagguggucaaaucuguugagcuugacgcccccaauuaccacuaugaagaguguagcugcuacccugaugcuggcgagauuacgugugugugccgcgacaacuggcauggguccaauagacccugggugucuuucaaccaaaaucuggaauaucagaucggauacaucugcagcggcgucuuuggggauaacccucggcccaaugacggaacaggcuccugugggccggugagcucuaacggagccuauggcguuaagggcuucuccuuuaaauacgggaauggaguguggauuggccgcaccaagagcacaaacucuagauccggguucgagaugaucugggauccuaauggauggaccgaaaccgacagcuccuuuucugucaaacaggacauuguggcgaucacagauuggagcggcuacuccgggucuuucguucagcaccccgagcucacgggccuggacugcauucggccuuguuucuggguggaacuuauccgcggaagacccaaggagagcaccaucugggccuccggcagcucuauuuccuuuugcggggucaacagcgauacagugggauggucuuggcccgacggcgcugagcugccuuucaccaucgauaaauga

SEQ ID NO: 199340 - RNA, 1410 nt, Artificial Sequence; identical to SEQ ID NO: 198953
  derived and/or modified sequence opt5 from neuraminidase__InfluenzaA__ABX10527

SEQ ID NO: 199341 - RNA, 1413 nt, Artificial Sequence
  derived and/or modified sequence opt5 from neuraminidase__InfluenzaA__ABX58242
augaaccccaaucagaagaucauuaccaucggcagcauuuccaucgccauugggaucaucucucugaugcuccaaauuggaaacaucauuagcaucuggacaucccacucuauucagacgggcagccagaaucauaccgggaucugcaaccagagaauuaucacauacgagaauagcaccugggugaaccacacauaugucucuaucaauaacaccaauguuguggcuggaaaagacaagacaagcgugacccuggccggcaacuccagccuuuguucuauuuccgggugggcgaucuacacgaaagauaauagcauucggaucggaucuaagggcgacgucuucgugauucgcgaaccuuuuaucuccugcagccaucuggaguguagaaccuucuuucucacacaaggcgcucugcuuaacgauaaacacucuaaugggaccguuaaggaccgguccccguaucgcgcccugaugagcugcccccucggagaagccccuucccccuacaacucuaaguucgagagcguggcuugguccgccagcgcuugucaugauggcaugggguggcugacaaucggaauuucuggcccugacaauggggccgucgcggugcugaaauauaacggaaucauuaccgaaacgaucaaguccuggaaaaagcggauucucagaacacaggagagcgagugcguuugugugaacggcucuugcuuuaccaucaugacagauggccccagcaauggggccgcuuccuacaaaaucuucaagauugaaaagggaaaagucaccaagucuaucgagcugaacgccccuaauuuucacuaugaagaguguagcugcuacccggacaccggcacagugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacgguggauggcgcugacggggucaaaggauucagcuacaaguauggcaacgggguguggauuggacgcaccaaaucuaauagacugcggaagggcuuugagaugaucugggaccccaacggguggacagauaccgacuccgauuucagcguuaagcaagacguggucgccauuacagauugguccggcuacucuggauccuuugugcagcauccggaacucaccggccuggacugcauccgcccuuguuucuggguugagcuugugagagggcugccccgggaaaauacgacaaucuggaccuccggaucuagcauuuccuucugcggcgucgauagcgacaccgcgaacuggucuuggccugauggggccgagcuccccuuuacaaucgacaaauga

SEQ ID NO: 199342 - RNA, 1413 nt, Artificial Sequence; identical to SEQ ID NO: 199153
  derived and/or modified sequence opt5 from neuraminidase__InfluenzaA__ABX58253

SEQ ID NO: 199343 - RNA, 1413 nt, Artificial Sequence; identical to SEQ ID NO: 199054
  derived and/or modified sequence opt5 from neuraminidase__InfluenzaA__ABX58264

SEQ ID NO: 199344 - RNA, 1413 nt, Artificial Sequence; identical to SEQ ID NO: 199054
  derived and/or modified sequence opt5 from neuraminidase__InfluenzaA__ABX58275

SEQ ID NO: 199345 - RNA, 1413 nt, Artificial Sequence; identical to SEQ ID NO: 199054
  derived and/or modified sequence opt5 from neuraminidase__InfluenzaA__ABX58286

SEQ ID NO: 199346 - RNA, 1413 nt, Artificial Sequence
  derived and/or modified sequence opt5 from neuraminidase__InfluenzaA__ABX58297
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagaaaauuaucaccuacgagaauagcacaugggugaaccacaccuaugucucuaucaauaacacaaauguuguggccggaaaggacaaaaccagcgugacacuggcgggcaacuccagccuuuguucuauuuccgggugggcuaucuacaccaaggauaauagcauuagaaucggaucuaaaggcgacgucuucgugauucgggaaccuuuuaucuccugcagccaucuggagugucgcacguucuuucucacccaaggcgcccugcuuaacgauaagcacucuaaugggacaguuaaggacagauccccguaucgggcccugaugagcugcccccucggagaagcuccuucccccuacaacucuaaauucgagagcguggccugguccgcuagcgccugucaugauggcaugggguggcugaccaucggaauuucuggcccugacaauggggcggucgccgugcugaaguauaacggaaucauuacagaaaccaucaaauccuggaagaaacgcauucucagaacgcaggagagcgagugcguuugugugaacggcucuugcuuuacaaucaugaccgauggccccagcaauggggcugccuccuacaagaucuucaagauugaaaaaggaaaggucacaaaaucuaucgagcugaacgcuccuaauuuucacuaugaagaguguagcugcuacccggacaccggcaccgugaugugugugugccgggauaacuggcacggguccaaucgccccugggucagcuucaaccagaaucuugacuaccagauuggauauaucugcucuggcguuuuuggggauaacccuagacccaaggacggaaaaggcuccuguaauccugugacaguggauggcgccgacggggucaagggauucagcuacaaauauggcaacgggguguggauuggacggacgaagucuaaucgccugagaaagggcuuugagaugaucugggaccccaacggguggaccgauacagacuccgauuucagcguuaaacaagacguggucgcgauuaccgauugguccggcuacucuggauccuuugugcagcauccggaacucacaggccuggacugcauccggccuuguuucuggguugagcuugugcgcgggcugcccagagaaaauaccacgaucuggacauccggaucuagcauuuccuucugcggcgucgauagcgacaccgccaacuggucuuggccugauggggcugagcuccccuuuaccaucgacaaguga

SEQ ID NO: 199347 - RNA, 1413 nt, Artificial Sequence; identical to SEQ ID NO: 199225
  derived and/or modified sequence opt5 from neuraminidase__InfluenzaA__ABX58308

SEQ ID NO: 199348 - RNA, 1413 nt, Artificial Sequence
  derived and/or modified sequence opt5 from neuraminidase__InfluenzaA__ABX58319
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaaucaaggaccgguccccguaucgcgcccugaugagcugcccccucggagaagcuccuucccccuacaacucuaaguucgagagcguugccugguccgcuagcgccugucaugauggcaugggguggcugaccauuggaaucucuggcccugacaauggggcgguggccguccugaaauauaacggaauuaucacagaaaccauuaaguccuggaaaaagagaauccuccggacgcaggagagcgagugcguguguguuaacggcucuugcuuuacaaucaugaccgauggccccagcaauggggcugccuccuacaaaauuuucaagaucgaaaagggaaaagugacaaagucuauugagcugaacgcuccuaauuuucacuaugaagaguguagcugcuacccggacaccggcaccgucaugugugugugccgcgauaacuggcacggguccaauagacccugggugagcuucaaccagaaucuugacuaccagaucggauauauuugcucuggcgucuuuggggauaacccucggcccaaagacggaaagggcuccuguaauccuguuacaguggauggcgccgacggggugaaaggauucagcuacaaguauggcaacggggucuggaucggacgcacgaaaucuaauagacugcggaagggcuuugagaugauuugggaccccaacggguggaccgauacagacuccgauuucagcgugaagcaagacguuguggcgaucaccgauugguccggcuacucuggauccuuuguccagcauccggaacucacaggccuggacugcauccgcccuuguuucuggguggagcuuguuagagggcugccccgggaaaauaccacgauuuggacauccggaucuagcaucuccuucugcggcguggauagcgacaccgccaacuggucuuggccugauggggcugagcuccccuuuaccauugacaaauga

SEQ ID NO: 199349 - RNA, 1413 nt, Artificial Sequence; identical to SEQ ID NO: 199225
  derived and/or modified sequence opt5 from neuraminidase__InfluenzaA__ABX58352

SEQ ID NO: 199350 - RNA, 1413 nt, Artificial Sequence; identical to SEQ ID NO: 199054
  derived and/or modified sequence opt5 from neuraminidase__InfluenzaA__ABX58363

SEQ ID NO: 199351 - RNA, 1413 nt, Artificial Sequence; identical to SEQ ID NO: 199054
  derived and/or modified sequence opt5 from neuraminidase__InfluenzaA__ABX58385

SEQ ID NO: 199352 - RNA, 1413 nt, Artificial Sequence; identical to SEQ ID NO: 199054
  derived and/or modified sequence opt5 from neuraminidase__InfluenzaA__ABX58396

SEQ ID NO: 199353 - RNA, 1413 nt, Artificial Sequence
  derived and/or modified sequence opt5 from neuraminidase__InfluenzaA__ABX58407
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguccuauuucugggugggcuaucuacaccaaagauaauuccauucggaucggaagcaagggcgacgucuucgugauucgcgagccguuuaucucuugcucccaucuggaguguagaacguucuuucucacccaaggcgcccugcuuaacgauaaacacagcaaugggacaguuaaggaccggucucccuaucgcgcccugauguccugcccucucggagaagcucccagcccuuacaacuccaaguucgagucuguggccuggagcgcuuccgccugucaugauggcaugggguggcugaccaucggaauuagcggccccgacaauggggcggucgccgugcugaaauauaacggaaucauuacagaaaccaucaagucuuggaaaaagcggauucucagaacgcaggaguccgagugcguuugugugaacggcagcugcuuuacaaucaugaccgauggcccuucuaauggggcugccagcuacaaaaucuucaagauugaaaagggaaaagucacaaaguccaucgagcugaacgcuccgaauuuucacuaugaagaguguucuugcuaccccgacaccggcaccgugaugugugugugccgcgauaacuggcacgggagcaauagaccuugggucuccuucaaccagaaucuugacuaccagauuggauauaucugcagcggcguuuuuggggauaacccccggccuaaagacggaaagggcucuuguaaucccgugacaguggauggcgccgacggggucaaaggauucuccuacaaguauggcaacgggguguggauuggacgcacgaaaagcaauagacugcggaagggcuuugagaugaucugggacccgaacggguggaccgauacagacucugauuucuccguuaagcaagacguggucgcgauuaccgauuggagcggcuacuccggaucuuuugugcagcauccugaacucacaggccuggacugcauccgccccuguuucuggguugagcuugugagagggcugccucgggaaaauaccacgaucuggacaagcggauccucuauuagcuucugcggcgucgauuccgacaccgccaacuggagcuggcccgauggggcugagcuccccuuuaccaucgacaaauga

SEQ ID NO: 199354 - RNA, 1413 nt, Artificial Sequence; identical to SEQ ID NO: 199095
  derived and/or modified sequence opt5 from neuraminidase__InfluenzaA__ABX58418

SEQ ID NO: 199355 - RNA, 1413 nt, Artificial Sequence; identical to SEQ ID NO: 199054
  derived and/or modified sequence opt5 from neuraminidase__InfluenzaA__ABX58429

SEQ ID NO: 199356 - RNA, 1413 nt, Artificial Sequence; identical to SEQ ID NO: 199054
  derived and/or modified sequence opt5 from neuraminidase__InfluenzaA__ABX58440

SEQ ID NO: 199357 - RNA, 1413 nt, Artificial Sequence
  derived and/or modified sequence opt5 from neuraminidase__InfluenzaA__ABX58451
augaaccccaaucagaagaucauuaccaucggcagcauuuccaucgccauugggacaaucucucugaugcuccaaaucggaaacauuaucagcauuugggcuucccacucuauccagacgggcagccagaaucauaccgggauuugcaaccagagaaucauuacauacgagaauagcaccugggugaaccacacauaugucucuaucaauaacaccaauguuguggccggaaaagacaagacaagcgugacccuggcgggcaacuccagccuuuguucuaucuccgggugggcuauuuacacgaaagauaauagcauccggauuggaucuaagggcgacgucuucgugauccgcgaaccuuuuauuuccugcagccaucuggaguguagaaccuucuuucucacacaaggcgcccugcuuaacgauaaacacucuaaugggaccguuaaggaccgguccccguaucgcgcccugaugagcugcccccucggagaagcuccuucccccuacaacucuaaguucgagagcguggccugguccgcuagcgccugucaugauggcaugggguggcugacaaucggaaucucuggcccugacaauggggcggucgccgugcugaaauauaacggaauuaucaccgaaacgauuaaguccuggaaaaagagaauccuccggacacaggagagcgagugcguuugugugaacggcucuugcuuuaccauuaugacagauggccccagcaauggggcugccuccuacaaaaucuucaagaucgaaaagggaaaagucaccaagucuauugagcugaacgcuccuaauuuucacuaugaagaguguagcugcuacccggacaccggcacagugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacgguggauggcgccgacggggucaaaggauucagcuacaaguauggcaacgggguguggaucggacgcaccaaaucuaauagacugcggaagggcuuugagaugauuugggaccccaacggguggacagauaccgacuccgauuucagcguuaagcaagacguggucgcgaucacagauugguccggcuacucuggauccuuugugcagcauccggaacucaccggccuggacugcauucgcccuuguuucuggguugagcuugugagagggcugccccgggaaaauacgacaaucuggaccuccggaucuagcaucuccuucugcggcgucgauagcgacaccgccaacuggucuuggccugauggggcugagcuccccuuuacaauugacaaauga

SEQ ID NO: 199358 - RNA, 1413 nt, Artificial Sequence; identical to SEQ ID NO: 199095
  derived and/or modified sequence opt5 from neuraminidase__InfluenzaA__ABX58462

SEQ ID NO: 199359 - RNA, 1413 nt, Artificial Sequence; identical to SEQ ID NO: 199054
  derived and/or modified sequence opt5 from neuraminidase__InfluenzaA__ABX58473

SEQ ID NO: 199360 - RNA, 1413 nt, Artificial Sequence; identical to SEQ ID NO: 199095
  derived and/or modified sequence opt5 from neuraminidase__InfluenzaA__ABX58484

SEQ ID NO: 199361 - RNA, 1413 nt, Artificial Sequence
  derived and/or modified sequence opt5 from neuraminidase__InfluenzaA__ABX58495
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgagccuuuuaucuccugcagccaucuggaguguagaacguucuuucucacccaaggcgcccugcuuaacgauaaacacucuaaucggacaguuaaggaccgcuccccguauagagcccugaugagcugcccccucggggaagcuccuucccccuacaacucuaaguucgagagcguggccugguccgcuagcgccugucaugauggaaugggcuggcugaccaucgggauuucuggaccugacaauggcgcggucgccgugcugaaauauaacgggaucauuacagaaaccaucaaguccuggaaaaagcggauucuccgcacgcaggagagcgagugcguuugugugaacggaucuugcuuuacaaucaugaccgauggccccagcaauggcgcugccuccuacaaaaucuucaagauugaaaaggggaaagucacaaagucuaucgagcugaacgcuccuaauuuucacuaugaagaguguagcugcuacccggacaccggaaccgugaugugugugugcagagauaacuggcacggcuccaaucggcccugggucagcuucaaccagaaucuugacuaccagauuggguauaucugcucuggaguuuuuggcgauaacccucgccccaaagacgggaagggauccuguaauccugugacaguggauggcgccgacggcgucaaaggguucagcuacaaguauggaaacggcguguggauugggagaacgaaaucuaaucggcugcgcaagggauuugagaugaucugggaccccaacggcuggaccgauacagacuccgauuucagcguuaagcaagacguggucgcgauuaccgauugguccggguacucuggcagcuuugugcagcauccggaacucacaggacuggacugcaucagaccuuguuucuggguugagcuugugcggggccugccccgcgaaaauaccacgaucuggacauccgggucuagcauuuccuucugcggagucgauagcgacaccgccaacuggucuuggccugauggcgcugagcuccccuuuaccaucgacaaauga

SEQ ID NO: 199362 - RNA, 1413 nt, Artificial Sequence; identical to SEQ ID NO: 199089
  derived and/or modified sequence opt5 from neuraminidase__InfluenzaA__ABX58506

SEQ ID NO: 199363 - RNA, 1413 nt, Artificial Sequence; identical to SEQ ID NO: 199095
  derived and/or modified sequence opt5 from neuraminidase__InfluenzaA__ABX58528

SEQ ID NO: 199364 - RNA, 1413 nt, Artificial Sequence; identical to SEQ ID NO: 199095
  derived and/or modified sequence opt5 from neuraminidase__InfluenzaA__ABX58539

SEQ ID NO: 199365 - RNA, 1413 nt, Artificial Sequence
  derived and/or modified sequence opt5 from neuraminidase__InfluenzaA__ABX58550
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaauaccacgaucuggacauccggaucuagcauuuccuucugcggcgucgauagcgacaccgccaacuggucuuggccugauggggcugagcuccccuuuaccguggacaaauga

SEQ ID NO: 199366 - RNA, 1413 nt, Artificial Sequence; identical to SEQ ID NO: 199054
  derived and/or modified sequence opt5 from neuraminidase__InfluenzaA__ABX58561

SEQ ID NO: 199367 - RNA, 1413 nt, Artificial Sequence
  derived and/or modified sequence opt5 from neuraminidase__InfluenzaA__ABX58572
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccuaugacaguggauggcgccgacggggugaaaggauucagcuacaaguauggcaacggggucuggauuggacgcacgaaaucuaauagacugcggaagggcuuugagaugaucugggaccccaacggguggaccgauacagacuccgauuucagcgugaagcaagacguuguggcgauuaccgauugguccggcuacucuggauccuuuguccagcauccggaacucacaggccuggacugcauccgcccuuguuucuggguggagcuuguuagagggcugccccgggaaaauaccacgaucuggacauccggaucuagcauuuccuucugcggcguggauagcgacaccgccaacuggucuuggccugauggggcugagcuccccuuuaccaucgacaaauga

SEQ ID NO: 199368 - RNA, 1413 nt, Artificial Sequence; identical to SEQ ID NO: 199054
  derived and/or modified sequence opt5 from neuraminidase__InfluenzaA__ABX58583

SEQ ID NO: 199369 - RNA, 1413 nt, Artificial Sequence; identical to SEQ ID NO: 199054
  derived and/or modified sequence opt5 from neuraminidase__InfluenzaA__ABX58594

SEQ ID NO: 199370 - RNA, 1413 nt, Artificial Sequence; identical to SEQ ID NO: 199080
  derived and/or modified sequence opt5 from neuraminidase__InfluenzaA__ABX58605

SEQ ID NO: 199371 - RNA, 1413 nt, Artificial Sequence; identical to SEQ ID NO: 199080
  derived and/or modified sequence opt5 from neuraminidase__InfluenzaA__ABX58616

SEQ ID NO: 199372 - RNA, 1413 nt, Artificial Sequence; identical to SEQ ID NO: 199054
  derived and/or modified sequence opt5 from neuraminidase__InfluenzaA__ABX58627

SEQ ID NO: 199373 - RNA, 1413 nt, Artificial Sequence; identical to SEQ ID NO: 199054
  derived and/or modified sequence opt5 from neuraminidase__InfluenzaA__ABX58638

SEQ ID NO: 199374 - RNA, 1413 nt, Artificial Sequence
  derived and/or modified sequence opt5 from neuraminidase__InfluenzaA__ABX58682
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccaugaugugugugugccgcgauaacuggcacggguccaauagacccugggugagcuucaaccagaaucuugacuaccagauuggauauaucugcucuggcgucuuuggggauaacccucggcccaaagacggaaagggcuccuguaauccuguuacaguggauggcgccgacggggugaaaggauucagcuacaaguauggcaacggggucuggauuggacgcacgaaaucuaauagacugcggaagggcuuugagaugaucugggaccccaacggguggaccgauacagacuccgauuucagcgugaagcaagacguuguggcgauuaccgauugguccggcuacucuggauccuuuguccagcauccggaacucacaggccuggacugcauccgcccuuguuucuggguggagcuuguuagagggcugccccgggaaaauaccacgaucuggacauccggaucuagcauuuccuucugcggcguggauagcgacaccgccaacuggucuuggccugauggggcugagcuccccuuuaccaucgacaaauga

SEQ ID NO: 199375 - RNA, 1413 nt, Artificial Sequence
  derived and/or modified sequence opt5 from neuraminidase__InfluenzaA__ABX58693
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggaaaagacaagaccucugugacacuggcgggcaacagcucccuuuguagcauuucugggugggcuaucuacaccaaagauaauuccauucggaucggaagcaagggcgacgucuucgugauucgcgaaccuuuuaucucuugcucccaccuggaguguagaacguucuuucucacccaaggcgcccugcuuaacgauaaacauagcaaugggacaguuaaggaccggucuccguaucgcgcccugauguccugcccccucggagaagcuccuagccccuacaacuccaaguucgagucuguggccuggagcgcuuccgccugucacgauggcaugggguggcugaccaucggaauuagcggcccugacaacggggcggucgccgugcugaaauauaauggaaucauuacaggcaccaucaagucuuggaaaaagcagauucucagaacgcaggaauccgagugcguuuguaugaacggcagcugcuuuacaaucaugaccgaugggcccucuaaucgggcugccagcuacaaaaucuucaagauugagaagggaaaagugacaaaguccaucgaacugaacgcuccuaauuuucauuaugaggaauguucuugcuacccggacaccggcauugucaugugugugugccgcgauaacuggcacgggagcaauagacccuggguguccuucaaccagaaucuugacuaccaaaucggauauauuugcagcggcguccugggggauaacccucggcccgaggacggagagggcucuuguaauccuguuaccguggauggcgccgacggggugaaaggauuuuccuacaaguaugacaacggcgucuggaucgggcgcacaaaaagcaauagacuccggaagggauucgaaaugauuugggaucccaacggcuggacgaauaccgacucugauuuuuccgugaaacaggacguuguggcgaucacagauuggagcggguacuccggcucuuucguccagcacccggagcugaccggacuugacugcauccgcccuuguuuuuggguggaacugguuagaggccucccccgggagaacacaaccauuuggacgagcggguccucuaucagcuucugcggagugaacuccgauacagccaauuggagcuggccugacggcgcugaacugcccuucaccauugauaaguga

SEQ ID NO: 199376 - RNA, 1413 nt, Artificial Sequence; identical to SEQ ID NO: 199225
  derived and/or modified sequence opt5 from neuraminidase__InfluenzaA__ABX58704

SEQ ID NO: 199377 - RNA, 1413 nt, Artificial Sequence; identical to SEQ ID NO: 199153
  derived and/or modified sequence opt5 from neuraminidase__InfluenzaA__ABX58715

SEQ ID NO: 199378 - RNA, 1350 nt, Artificial Sequence
  derived and/or modified sequence opt5 from neuraminidase__InfluenzaA__ABY19420
augaaccccaaucagaaggugaucaccauuggcagcaucugcauggucauugggaucguuucccugaugcuccaaauuggaaacaugaucucuaucugggugagccacuccauucagacaggcaaucagaaccagguggagccuaucauuaauacgaacuuccugaccgggaaagccgucgcuucuaucacacuugccggaaauagcucccuguguccgauuagaggcugggcgauccauucuaaggacaacagcauucggaucggguccaaaggagauguguuuguuauccgcgaacccuucauuagcugcucucaccucgaguguagaaccuuuuuccugacacaaggcgcccuucugaaugacaagcauuccaacggcaccgugaaagaucggagcccucaccgcacacucaugucuugccccgucggggaagcuccuucccccuacaauagcagauuugagucuguggccugguccgcuagcgccugucaugacggaaccuccuggcugacgaucggcauuucugggccugauaacggagcuguugccgugcugaaguauaauggcaucauuaccgacacaaucaagagcuggcggaacaauauccuccgcacccaggaauccgagugcgcgugugucaacgggagcugcuucacagugaugaccgauggaccgucuaacggccaggccuccuacaaaauuuuuaagauggagaaaggcaaggugaucaaaagcgucgaacuggacgcucccaauuaucacuacgaggaauguucuugcuauccugaugccggggagauuacguguguuugcagagacaacuggcacggaagcaaucggcccuggguguccuucaaccagaaucuugaguaccaaaucggcuauauuugcucugggguguuuggagauaacccucgccccaaugacggcacagggagcuguggaccggucucccauaacggcgcuuacggcgugaagggguucagcuuuaaguacggaaauggcguuuggaucgggagaaccaaaucuccuaacucccggagcggauucgaaaugaucugggaucccaauggcuggucugagacagacuccagcuuuuccgugaagcaggacauugucgccaucaccgauuggucuggguauagcggcuccuucgugcagcacccugaacugaccggacucgacugcauucgccccuguuucuggguugagcugaucagaggccggcccaaagaaucuacaguguggacgagcggguccagcauuucuuuuugcggagucaacuccgauaccgugagcuggucuuggccugacggcgcggagcuuccguucuccaucgauaaguga

SEQ ID NO: 199379 - RNA, 1350 nt, Artificial Sequence
  derived and/or modified sequence opt5 from neuraminidase__InfluenzaA__ABY19421
augaaccccaaucagaagaucauuaccaucggcagcauuugcauggugaucgggauugucucccugaugcuccaaaucggaaacaugaucucuauuuggguuagccacuccauccagacaggcaaucagaaccagguggagccuauuaucaauacgaacuuccugaccgggaaagccguggcuucuauuacacuugccggaaauagcucccuguguccgaucagaggcugggcgauucauucuaaggacaacagcauccggaucggguccaaaggagaugucuuugugauucgcgaacccuucaucagcugcucucaccucgaguguagaaccuuuuuccugacacaaggcgcccuucugaaugacaagcauuccaacggcaccguuaaagaucggagcccucaccgcacacucaugucuugccccgugggggaagcuccuucccccuacaauagcagauuugagucugucgccugguccgcuagcgccugucaugacggaaccuccuggcugacgauuggcaucucugggccugauaacggagcuguggccguucugaaguauaauggcauuaucaccgacacaaucaagagcuggcggaacaauauucuccgcacccaggaauccgagugcgcgugugugaacgggagcugcuucacagucaugaccgauggaccgucuaacggccaggccuccuacaaaaucuuuaagauggagaaaggcaaggugauuaaaagcguggaacuggacgcucccaauuaucacuacgaggaauguucuugcuauccugaugccggggagaucacgugugucugcagagacaacuggcacggaagcaaucggcccuggguuuccuucaaccagaaucuugaguaccaaauuggcuauaucugcucugggguguuuggagauaacccucgccccaaugacggcacagggagcuguggaccggugucccauaacggcgcuuacggcgucaagggguucagcuuuaaguacggaaauggcguguggaucgggagaaccaaaucuccuaacucccggagcggauucgaaaugauuugggaucccaauggcuggucugagacagacuccagcuuuuccguuaagcaggacaucguggccauuaccgauuggucuggguauagcggcuccuucguccagcacccugaacugaccggacucgacugcauccgccccuguuucuggguggagcugauuagaggccggcccaaagaaucuacaguuuggacgagcggguccagcaucucuuuuugcggagugaacuccgauaccgucagcuggucuuggccugacggcgcggagcuuccguucuccauugauaaguga

SEQ ID NO: 199380 - RNA, 1413 nt, Artificial Sequence
  derived and/or modified sequence opt5 from neuraminidase__InfluenzaA__ABY51020
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccucugacaguggauggcgccgacggggugaaaggauucagcuacaaguauggcaacggggucuggauuggacgcacgaaaucuaauagacuccggaagggcuuugagaugaucugggaccccaacggguggaccgauacagacuccgauuucagcgugaagcaagacguuguggcgauuaccgauugguccggcuacucuggauccuuuguccagcauccggaacugacaggccuugacugcauccgcccuuguuucuggguggagcugguuagagggcucccccgggaaaauaccacgaucuggacauccggaucuagcauuuccuucugcggcguggauagcgacaccgccaacuggucuuggccugauggggcugagcugcccuuuaccaucgacaaauga

SEQ ID NO: 199381 - RNA, 1410 nt, Artificial Sequence; identical to SEQ ID NO: 199090
  derived and/or modified sequence opt5 from neuraminidase__InfluenzaA__ABY51031

SEQ ID NO: 199382 - RNA, 1413 nt, Artificial Sequence
  derived and/or modified sequence opt5 from neuraminidase__InfluenzaA__ABY51042
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacaggcaccaucaagucuuggaaaaagcagauucucagaacgcaggaauccgagugcguuuguaugaauggcagcugcuuuacaaucaugaccgaugggcccucuaaccgggcugccagcuacaaaaucuucaagauugagaagggaaaagugacaaaguccaucgaacugaaugcuccuaacuuucacuaugaggaauguucuugcuacccggacaccggcauugucaugugugugugccgcgauaauuggcacgggagcaacagacccuggguguccuucaaucagaaccuugacuaccaaaucggauauauuugcagcggcgucuuuggggauaauccucggcccaaagacggagagggcucuuguaacccuguuaccguggauggcgccgacggggugaagggauucuccuacaaauaugacaauggcgucuggaucgggcgcacaaagagcaacagacugcggaaaggauuugagaugauuugggaucccaauggcuggacgaacaccgacucugauuucuccgugaagcaggacguuguggcgaucacagauuggagcggguacuccggcucuuuuguccagcauccggaacucaccggacuggacugcauccgcccuuguuucuggguggagcuuguuagaggccugccccgggaaaauacaaccauuuggacgagcggguccucuaucagcuucugcggagugaacuccgauacagccaacuggagcuggccugacggcgcugagcuccccuuuaccauugauaaguga

SEQ ID NO: 199383 - RNA, 1413 nt, Artificial Sequence
  derived and/or modified sequence opt5 from neuraminidase__InfluenzaA__ABY51053
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggaaaagacaagaccucugugacacuggcgggcaacagcucccuuuguagcauuucugggugggcuaucuacaccaaagauaauuccauucggaucggaagcaagggcgacgucuucgugauucgcgaaccuuuuaucucuugcucccaccuggaguguagaacguucuuucucacccaaggcgcccugcuuaacgauaaacauagcaaugggacaguuaaggaccggucuccguaucgcgcccugauguccugcccccucggagaagcuccuagccccuacaacuccaaguucgagucuguggccuggagcgcuuccgccugucacgauggcaugggguggcugaccaucggaauuagcggcccugacaacggggcggucgccgugcugaaauauaauggaaucauuacaggcaccaucaagucuuggaaaaagcagauucucagaacgcaggaauccgagugcguuuguaugaacggcagcugcuuuacaaucaugaccgaugggcccucuaaucgggcugccagcuacaaaaucuucaagauugagaagggaaaagugacaaaguccaucgaacugaacgcuccuaauuuucauuaugaggaauguucuugcuacccggacaccggcauugucaugugugugugccgcgauaacuggcacgggagcaauagacccuggguguccuucaaccagaaucuugacuaccaaaucggauauauuugcagcggcgucuuuggggauaacccucggcccgaggacggagagggcucuuguaauccuguuaccguggauggcacagacggggugaaaggauucuccuacaaguaugacaacggcgucuggaucgggcgcacgaaaagcaauagacugcggaagggauuugaaaugauuugggaucccaacggcuggaccaauacagacucugauuucuccgugaaacaggacguuguggccaucaccgauuggagcggguacuccggcucuuuuguccagcacccggagcucacaggacuggacugcauccgcccuuguuucuggguggaacuuguuagaggccugccccgggagaacaccacgauuuggacaagcggguccucuaucagcuucugcggagugaacuccgauaccgcgaauuggagcuggccugacggcgccgaacuccccuuuaccauugauaaguga

SEQ ID NO: 199384 - RNA, 1413 nt, Artificial Sequence; identical to SEQ ID NO: 199153
  derived and/or modified sequence opt5 from neuraminidase__InfluenzaA__ABY51064

SEQ ID NO: 199385 - RNA, 1413 nt, Artificial Sequence; identical to SEQ ID NO: 199054
  derived and/or modified sequence opt5 from neuraminidase__InfluenzaA__ABY51075

SEQ ID NO: 199386 - RNA, 1413 nt, Artificial Sequence
  derived and/or modified sequence opt5 from neuraminidase__InfluenzaA__ABY51086
augaaccccaaucagaagaucauuaccaucggcagcauuuccaucgccauugggaucaucucuauuaugcugcaaaucggaaacauuaucagcauuugggcuucccacucuauccagacaggcagccagaaucauacggggauuugcaaccagagaaucaucaccuacgaaaauuccacaugggugaaccacaccuaugucaauauuaacaauacaaacguuguggccgagaaagacaagaccucugugacacucgcgggaaauagcucccuguguagcaucucuggcugggcuauuuacaccaaagauaacuccauccggauugggagcaagggagacgucuucgugauccgcgagccuuuuaucucuugcucccaucuugaauguagaacguucuuucugacccaaggcgcccuccugaaugauaaacacagcaacggcacaguuaaggaccggucuccguaucgcgcccuuauguccugcccccugggggaggcuccuagccccuacaauuccaaguucgaaucuguggccuggagcgcuuccgccugucaugauggaaugggcuggcucaccauugggaucagcggaccugacaacggcgcggucgccgugcugaaauauaacgggauuaucacagagaccauuaagucuuggaaaaagagaauccugcggacgcaggaguccgaaugcguuugugugaauggaagcugcuuuacaaucaugaccgauggccccucuaacggcgcugccagcuacaaaauuuucaagaucgagaaggggaaagucacaaaguccauugaacucaaugcuccuaacuuucacuaugaggaguguucuugcuacccggacaccggaaccgugaugugugugugccgcgauaauuggcacggcagcaacagacccugggucuccuucaaucagaaccuggacuaccagaucggguauauuugcagcggaguuuuuggcgauaauccucggcccaaagacgggaagggaucuuguaacccugugacaguggauggcgccgacggcaucaaaggguucuccuacaaguauggaaauggcgucuggauugggcgcacgaaaagcaacagacuucggaagggauuugaaaugaucugggaccccaauggcuggaccaacacagauucugacuucuccgugaagcaagauguuguggcgaucaccgacuggagcggguacuccggcucuuuuguccagcauccggagcugacaggacucgauugcauucgcccuuguuucuggguggaacugguuagaggccuuccccgggagaauaccacgaucuggacaagcggguccucuauuagcuucugcggaguggacggcgauaccgccaacugguccuggccugacggggcugaacugcccuuuaccaucgauaaauga

SEQ ID NO: 199387 - RNA, 1413 nt, Artificial Sequence
  derived and/or modified sequence opt5 from neuraminidase__InfluenzaA__ABY51097
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuguggagcugaacgcuccuaauuuucacuaugaagaguguagcugcuacccggacaccggcaccgugaugugugucugccgcgauaacuggcacggguccaauagacccuggguuagcuucaaccagaaucuugacuaccagaucggauauauuugcucuggcguguuuggggauaacccucggcccaaagacggaaagggcuccuguaauccugugacagucgauggcgccgacggggugaaaggauucagcuacaaguauggcaacgggguuuggaucggacgcacgaaaucuaauagacugcggaagggcuuugagaugauuugggaccccaacggguggaccgauacagacuccgauuucagcgugaagcaagacgucguggcgaucaccgauugguccggcuacucuggauccuuuguucagcauccggaacucacaggccuggacugcauucgcccuuguuucuggguggagcuugucagagggcugccccgggaaaauaccacgaucuggacauccggaucuagcaucuccuucugcggcguggauagcgacaccgccaacuggucuuggccugauggggcugagcuccccuuuaccauugacaaauga

SEQ ID NO: 199388 - RNA, 1413 nt, Artificial Sequence
  derived and/or modified sequence opt5 from neuraminidase__InfluenzaA__ABY51108
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacauuguggcgaucaccgauugguccggcuacucuggauccuuuguccagcauccggaacucacaggccuggacugcauccgcccuuguuucuggguggagcuuguuagagggcugccccgggaaaauaccacgauuuggacauccggaucuagcaucuccuucugcggcguggauagcgacaccgccaacuggucuuggccugauggggcugagcuccccuuuaccauugacaaauga

SEQ ID NO: 199389 - RNA, 1413 nt, Artificial Sequence; identical to SEQ ID NO: 199054
  derived and/or modified sequence opt5 from neuraminidase__InfluenzaA__ABY51119

SEQ ID NO: 199390 - RNA, 1410 nt, Artificial Sequence; identical to SEQ ID NO: 198908
  derived and/or modified sequence opt5 from neuraminidase__InfluenzaA__ABY51130

SEQ ID NO: 199391 - RNA, 1413 nt, Artificial Sequence; identical to SEQ ID NO: 199095
  derived and/or modified sequence opt5 from neuraminidase__InfluenzaA__ABY51141

SEQ ID NO: 199392 - RNA, 1413 nt, Artificial Sequence
  derived and/or modified sequence opt5 from neuraminidase__InfluenzaA__ABY51152
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaauaccacgaucuggacauccggaucuagcauuuccuucugcggcgucaacagcgauaccgccaauuggucuuggccugacggggcugagcuccccuuuaccaucgauaaauga

SEQ ID NO: 199393 - RNA, 1413 nt, Artificial Sequence
  derived and/or modified sequence opt5 from neuraminidase__InfluenzaA__ABY51163
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugauucuggcgggcaauagcucccuuuguagcaucucugggugggcuauuuacacaaaagauaacuccauccggauuggaagcaagggcgacgucuucgugauccgcgagccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagagaauccuccggacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugaccguggauggcgccgacggggucaaaggauucuccuacaaguauggcaaugggguguggaucggacgcacaaaaagcaacagacugcggaagggcuuugagaugauuugggaccccaauggguggacggauaccgacucugauuucuccguuaagcaagacguggucgcgaucacagauuggagcggcuacuccggaucuuuugugcagcauccggaacucaccggccuggacugcauccgcccuuguuucuggguugagcuugugagagggcugccccgggaaaacacaaccauuuggacgagcggauccucuaucagcuucugcggcgucgauuccgacacagccaauuggagcuggccugauggggcugagcuccccuuuaccauugacaaauga

SEQ ID NO: 199394 - RNA, 1413 nt, Artificial Sequence
  derived and/or modified sequence opt5 from neuraminidase__InfluenzaA__ABY51174
augaaccccaaucagaagaugaucaccauuggcagcaucuccauugccaucgggauuaucucucugaugcuccaaaucggaaacauuaucagcauuugggcuucccacucuauccagacaggcagccagaaucauacggggauuugcaaccagagaaucauuaccuacgaaaauuccacaugggugaaccacaccuaugucaauaucaacaauacaaacguuguggccggaaaagacaagaccucugugacacuggcgggcaauagcucccuuuguagcaucucugggugggcuauuuacaccaaagauaacuccauccggauuggaagcaagggcgacgucuucgugauccgcgagccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagagaauccuccggacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgcgauaauuggcacgggagcaacagacccugggucuccuucaaucagaaccuugacuaccagguuggauauaucugcagcggcguguuuggggauaauccucggcccaaagacggaaagggcucuuguaacccuaugacaguggauggcgccgacggggucaaaggauucuccuacaaguauggcaaugggguguggauuggacgcacgaaaagcaacaagcugagaaagggcuuugagaugaucugggaccccaauggguggaccgauacagacucugauuucuccguuaaacaagacguggucgcgauuaccgauuggagcggcuacuccggaucuuuugugcagcauccggaacucacaggccuggacugcauccggccuuguuucuggguugagcuugugcgcgggcugcccagagaaaacaccacgauuuggacaagcggauccucuaucagcuucugcggcgucgauuccgacaccgccaauuggagcuggccugauggggcugagcuccccuuuaccaucgacaaguga

SEQ ID NO: 199395 - RNA, 1413 nt, Artificial Sequence; identical to SEQ ID NO: 199054
  derived and/or modified sequence opt5 from neuraminidase__InfluenzaA__ABY51185

SEQ ID NO: 199396 - RNA, 1413 nt, Artificial Sequence; identical to SEQ ID NO: 199089
  derived and/or modified sequence opt5 from neuraminidase__InfluenzaA__ABY51196

SEQ ID NO: 199397 - RNA, 1410 nt, Artificial Sequence; identical to SEQ ID NO: 199090
  derived and/or modified sequence opt5 from neuraminidase__InfluenzaA__ABY51229

SEQ ID NO: 199398 - RNA, 1413 nt, Artificial Sequence
  derived and/or modified sequence opt5 from neuraminidase__InfluenzaA__ABY51240
augaaccccaaucagaagaucauuaccaucggcagcauuuccaucgccauugggaucaucucucugaugcuccaaauuggaaacaucauuagcgugugggcuucccacucuauccagacaggcagccagaaucauacggggauuugcaaccagagaaucauuaccuacgaaaauuccacaugggucaaccacaccuauguuucuaucaauaacacaaaugugguggccggaaaagacaagaccagcgucacacuggcgggcaacuccagccuuuguucuaucuccggguggagcauuuacaccaaagauaauucuauccggauuggauccaagggcgacguguucguuauccgcgagccuuuuauuagcugcucucaucuggaguguagaacguucuuucucacccaaggcgcucugcuuaacgauaaacacuccaaugggacagugaaggaccggagcccguaucgcgcccugauguccugcccccucggagaagccccuucucccuacaacagcaaguucgaguccgucgcuuggagcgccucugcuugucaugauggcaugggguggcugaccaucggaaucuccggcccugacaauggggccguggcgguucugaaauauaacggaauuaucacagaaaccauuaagagcuggaaaaagagaauccuccggacgcaggagucugagugcgugugugucaacggcagcugcuuuacaauuaugaccgauggccccuccaauggggccgcuucuuacaaaaucuucaagaucgaaaagggaaaagugacaaagagcauugagcugaacgccccuaauuuucacuaugaagaguguuccugcuacccggacaccggcaccgugaugugugucugccgcgauaacuggcacgggagcaauagacccuggguuucuuucaaccagaaucuugacuaccagaucggauauauuugcuccggcguguuuggggauaacccucggcccaaagacggaaagggcagcuguaauccugugacagucgauggcgcugacggggugaaaggauucucuuacaaguauggcaacgggguuuggaucggacgcacgaaauccaauagacugcggaagggcuuugagaugauuugggaccccaacggguggaccgauacagacagcgauuucuccgugaagcaagacgucguggccaucaccgauuggucuggcuacagcggauccuuuguucagcauccggaacucacaggccuggacugcauucgcccuuguuucuggguggagcuugucagagggcugccccgggaaaauaccacgaucuggacaucuggaagcuccaucagcuucugcggcguggauucugacaccgcgaacugguccuggccugauggggccgagcuccccuuuaccauugacaaauga

SEQ ID NO: 199399 - RNA, 1413 nt, Artificial Sequence; identical to SEQ ID NO: 199080
  derived and/or modified sequence opt5 from neuraminidase__InfluenzaA__ABY51251

SEQ ID NO: 199400 - RNA, 1413 nt, Artificial Sequence
  derived and/or modified sequence opt5 from neuraminidase__InfluenzaA__ABY51262
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaaugccaccaucuggacguccggaucuagcauuuccuucugcggcgucgauagcgacacagcuaacuggucuuggccugauggggccgagcuccccuuuaccaucgacaaauga

SEQ ID NO: 199401 - RNA, 1410 nt, Artificial Sequence; identical to SEQ ID NO: 198908
  derived and/or modified sequence opt5 from neuraminidase__InfluenzaA__ABY51273

SEQ ID NO: 199402 - RNA, 1350 nt, Artificial Sequence
  derived and/or modified sequence opt5 from neuraminidase__InfluenzaA__ABY76285
augaaccccaaucagaagaucauuaccaucggcagcauuugcauggugaucgggauugucucccugaugcuccaaaucggaaacaugaucucuauuuggguuagccacuccauccagacaggcaaucagagacaggccgagccuauuucuaacacgaaauuccugaccgaaaaggcuguggccagcgugacacuugcgggaaauuccucucuguguccgaucagcgggugggcugucuacuccaaagacaacagcauucggaucggcucuaagggggauguguuuguuauucgcgagcccuucaucuccugcagccaucucgaauguagaaccuuuuuccugacacaaggagcccuucugaaugacaaacacucuaacggcaccgugaaggaucgguccccucaucgcacacucaugagcugccccgucggcgaggccccuucucccuauaauuccagauuugaaagcguggcuugguccgccucugcuugucacgacgggaccagcuggcugacgaucggaauuuccggcccugauaacggggccguugcggugcugaaguacaauggaaucauuaccgacacaaucaaaagcuggcggaacaauauucuccgcacccaggagucugagugcgccugugucaacggcuccugcuucacagugaugaccgaugggccgagcaauggacaggcuucuuauaagaucuuuaaaauggaaaagggcaaaguggucaagagcguugagcuggacgcccccaacuaccauuaugaagaguguuccugcuacccugaugcuggcgagaucacgugugugugcagagacaacuggcacgggucuaaucggcccugggugagcuucaaccagaaucuugaauaucaaauuggauacaucugcuccggcgucuuuggggauaacccucgccccaaugacggaacaggcagcugugggccggugucuccuaacggagccuacggcguuaagggcuucuccuuuaaauaugggaauggaguguggauuggcagaaccaagagcacaaacucucgguccggguucgagaugaucugggaucccaauggauggaccggcaccgacagcuccuuuucugucaaacaggacauuguggcgaucacagauuggagcggguacuccggcucuuucguucagcacccugaacugacgggacucgacugcauccgccccuguuucuggguggagcugauuagaggccggcccaaggaaagcaccaucuggacauccgggagcucuauuuccuuuugcggagucaacagcgauaccgugucuugguccuggccugacggcgccgagcuuccguucacaaucgauaaauga

SEQ ID NO: 199403 - RNA, 1413 nt, Artificial Sequence
  derived and/or modified sequence opt5 from neuraminidase__InfluenzaA__ABY81352
augaaccccaaucagaagaucauuaccaucggcagcauuugcauggccaucgggauuaucucccugauccuccaaauuggaucuaucauuagcaucugggugucccacucuauucagacaggcagccagaaccauacggggaucuguaaucagagaauuaucaccuacgagaacuccacaugggucaaucaaaccuauguuaacaucucuaauacaaacgugguggcuggaaaagacaccacaagcaugacccuggccggcaauuccagccuuugcccuauucgggggugggcgaucuacucuaaggauaacuccauucgcaucggaagcaaaggcgacgucuucgugauuagagaaccguuuaucucuuguucccaccuggagugccggacguucuuucucacccagggcgcucugcuuaaugauaagcauagcaacgggacaguuaaagaccgcucucccuauagagcccugauguccuguccuaucggagaagcccccagcccuuacaauucccgguucgagucuguggcuuggagcgccuccgcuugccacgauggcaugggguggcucaccauuggaaucagcggccccgacgauggggccgucgcggugcugaaguauaacggaauuaucacagaaaccauuaagucuuggcgcaaacagauccugagaacgcaggaguccgaguguguuugcgugaauggcagcuguuuuacaaucaugaccgacggcccuucugaugggcaagccagcuaccggauuuucaagaucgaaaaaggaaagauuacaaaauccaucgagcucgacgcuccgaacucucauuaugaagagugcagcuguuaccccgauaccggcaccgucaugugcgugugccgcgacaacuggcacggguccaauagaccuugggugagcuuuaaccagaaucuggauuaccagauuggauauaucuguucuggcgucuucggggacaacccccggccuaaggacggaaagggcuccugcgaucccguuaauguggacggcgccgauggggugaaaggauuuagcuaccgcuauggcaacggggucuggauuggaagaacaaagucuaauuccagccggaaaggcuucgagaugaucugggacccgaacggguggacggauaccgacuccaauuuucuugugaagcaggauguuguggcuaugacagacuggucuggcuacagcggauccuucguccaacacccugaacugaccggccucgauuguaugcgccccugcuuuuggguggagcugaucagagggcggccuagagagaaaacaaccauuuggacgucuggaagcuccaucagcuucuguggcguuaacucugacacagugaauugguccuggcccgauggggccgaacuucccuucaccauugacaaguga

SEQ ID NO: 199404 - RNA, 1413 nt, Artificial Sequence
  derived and/or modified sequence opt5 from neuraminidase__InfluenzaA__ABY81363
augaaccccaaucagaagaucauuaccaucggcagcauuuccaucgccauugggaucaucucucugaugcuccaaauuggaaacaucauuagcaucugggcuucccacucuauucagaucggcagccagaaucauacagggauuugcaaccagagaaucaucacguacgagaauagcaccugggugaaccacacauaugucucuauuaauaacaccaauguuguggccggaaaagacaagacaagcgugacccuggcgggcaacuccagccuuuguucuaucuccgggugggcuauuuacacaaaagauaauagcauccggauuggaucuaagggcgacgucuucgugauccgcgaaccuuuuaucuccugcagccaucuggaguguagaaccuucuuucucacgcaaggcgcccugcuuaacgauaaacacucuaaugggaccguuaaggaccgguccccguaucgcgcccugaugagcugcccccucggagaagcuccuucccccuacaacucuaaguucgagagcguggccugguccgcuagcgccugucaugauggcaugggguggcugacaauuggaaucucuggcccugacaauggggcggucgccgugcugaaauauaacggaauuaucaccgaaacaauuaaguccuggaaaaagagaauccuccggacccaggagagcgagugcguuugugugaacggcucuugcuuuacgaucaugacagauggccccagcaauggggcugccuccuacaaaauuuucaagaucgaaaagggaaaagucaccaagucuauugagcugaacgcuccuaauuuucacuaugaagaguguagcugcuacccggacacaggcaccgugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugaccguggauggcgccgacggggucaaaggauucagcuacaaguauggcaacgggguguggaucggacgcacaaaaucuaauagacugcggaagggcuuugagaugauuugggaccccaacggguggacggauaccgacuccgauuucagcguuaagcaagacguggucgcgaucacagauugguccggcuacucuggauccuuugugcagcauccggaacucaccggccuggacugcauccgcccuuguuucuggguugagcuugugagagggcugccccgggaaaauacaaccauuuggacguccggaucuagcaucuccuucugcggcgucgauagcgacacagccaacuggucuuggccugauggggcugagcuccccuuuaccauugacaaauga

SEQ ID NO: 199405 - RNA, 1410 nt, Artificial Sequence; identical to SEQ ID NO: 199090
  derived and/or modified sequence opt5 from neuraminidase__InfluenzaA__ABY81374

SEQ ID NO: 199406 - RNA, 1413 nt, Artificial Sequence; identical to SEQ ID NO: 199054
  derived and/or modified sequence opt5 from neuraminidase__InfluenzaA__ABY81385

SEQ ID NO: 199407 - RNA, 1413 nt, Artificial Sequence
  derived and/or modified sequence opt5 from neuraminidase__InfluenzaA__ABY81407
augaaccccaaucagaagaucauuaccaucggcagcauuuccaucgccauugggacaaucucucugaugcuccaaaucggaaacauuaucagcauuugggcuucccacucuauccagacgggcagccagaaucauaccgggauuugcaaccagagaaucauuacauacgaaaauuccaccugggugaaccacacauaugucucuaucaauaacaccaauguuguggccggaaaagacaagacaagcgugacccuggcgggcaacuccagccuuuguucuaucuccgggugggcuauuuacacgaaagauaauagcauccggauuggaucuaagggcgacgucuucgugauccgcgagccuuuuauuuccugcagccaucuggaguguagaaccuucuuucucacacaaggcgcccugcuuaacgauaaacacucuaaugggaccguuaaggaccgguccccguaucgcgcccugaugagcugcccccucggagaagcuccuucccccuacaacucuaaguucgagagcguggccugguccgcuagcgccugucaugauggcaugggguggcugacaaucggaaucucuggcccugacaauggggcggucgccgugcugaaauauaacggaauuaucaccgaaacgauuaaguccuggaaaaagagaauccuccggacacaggagagcgagugcguuugugugaacggcucuugcuuuaccauuaugacagauggccccagcaauggggcugccuccuacaaaaucuucaagaucgaaaagggaaaagucaccaagucuauugagcugaacgcuccuaauuuucacuaugaagaguguagcugcuacccggacaccggcacagugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacgguggauggcgccgacggggucaaaggauucagcuacaaguauggcaacgggguguggaucggacgcaccaaaucuaauagacugcggaagggcuuugagaugauuugggaccccaacggguggacagauaccgacuccgauuuccucguuaagcaagacguggucgcgaucacagauuggagcggcuacuccggaucuuuugugcagcauccggaacugaccggccuugacugcauucgcccuuguuucuggguugagcuggugagagggcucccccgggaaaauacgacaaucuggaccagcggauccucuaucagcuucugcggcgucgauuccgacaccgccaacuggagcuggccugauggggcugagcugcccuuuacaauugacaaauga

SEQ ID NO: 199408 - RNA, 1410 nt, Artificial Sequence; identical to SEQ ID NO: 199090
  derived and/or modified sequence opt5 from neuraminidase__InfluenzaA__ACA24505

SEQ ID NO: 199409 - RNA, 1413 nt, Artificial Sequence; identical to SEQ ID NO: 199054
  derived and/or modified sequence opt5 from neuraminidase__InfluenzaA__ACA24516

SEQ ID NO: 199410 - RNA, 1413 nt, Artificial Sequence; identical to SEQ ID NO: 199054
  derived and/or modified sequence opt5 from neuraminidase__InfluenzaA__ACA24527

SEQ ID NO: 199411 - RNA, 1410 nt, Artificial Sequence
  derived and/or modified sequence opt5 from neuraminidase__InfluenzaA__ACA24692
augaaccccaaucagaagaucauuaccaucggcagcgugucccugacaauuucuacgaucugcuucuuuaugcaaauugccauccucaucaccacagucacccugcacuucaaacaguacgaguuuagcccuccgcccaacaaucagguuaugcuuugugaaccuacaauuaucgagagaaacauuaccgaaaucguguaucugacaaauaccacgauugagaaggaaaucugccccaaacucgcugaguaccggaacugguccaagccucagugugacauuaccggguucgcccccuuuucuaaagauaauagcauccgccuguccgcgggaggcgacaucugggugacaagagagccuuaugucucuugcgauccggacaaguguuaccaauucgcucuugggcagggaaccacacugaacaaugugcauagcaacgauaccguucacgaccggacgcccuaucgcacacuccugaugaaugaacugggcgugccuuuucaucucgggaccaagcaggucugcauugccugguccucuagcuccugucacgauggaaaagccuggcugcaugugugcguuacaggcgacgauaagaacgcuaccgccagcuucaucuacaauggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccccgcuacccuggcgugagaugugucugccgggauaauuggaaggggagcaaccgccccaucguggacauuaacaucaaagacuacucuauuguuuccaaguauguguguagcggacuugucggcgauaccccgcggaaaaaugacucuagcuccucuagccauugccuggauccuaacaaugaggaaggcgggcacggagugaagggcugggccuucgacgaugggaacgacguuuggaugggaagaacgaucuccgagaaaagccgcucuggcuacgagacauuuaaggugaucgaagggugguccaaucccaacagcaaacuccagauuaauagacaggucaucguggaucggggaaaccgcucuggcuauuccggcauuuucagcgucgaggggaaguccuguaucaauagaugcuuuuacguggaacugauucggggaagaaacgaggaaaccgagguucuguggaccucuaauagcaucguggucuucuguggcacauccgggaccuauggaacaggcucuuggccugacggggcugauauuaaccucaugcccaucuga

SEQ ID NO: 199412 - RNA, 1410 nt, Artificial Sequence
  derived and/or modified sequence opt5 from neuraminidase__InfluenzaA__ACA24703
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauauuaccaucgagaaggaaacgugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaugccgacacaaagauccucuuuaucgaggaagggaaaauuguucacaccucuacacugagcggauccgcgcaacacguggaggaaugcagcugcuauccucgcuaccccggcgugagaugugucugccgggauaacuggaaggggucuaaccgcccuaucguggacauuaauaucaaggacuacuccauuguuagcagauauguguguucuggacuugucggcgauacgccccggaaaaacgacagcuccucuagcucccauugccuggauccgaauaacgaggaaggcgggcacggagugaagggcugggccuucgacgaugggaaugacguuuggaugggacgcaccaucagcgagaaaucuagauccggcuacgagacauuuaaggugaucgaaggguggagcaacccuaauucuaaacuccagauuaaccggcaggucaucguggaucgcggaaauagauccggcuauagcggcauuuucuccgucgaggggaagucuuguaucaaccggugcuuuuacguggaacugauuagaggacgcaaagaggaaaccgagguucuguggaccagcaauuccaucguggucuucuguggcacaucugggaccuauggaacaggcagcuggcccgacggggcugauauuaaccucaugccuaucuga

SEQ ID NO: 199413 - RNA, 1413 nt, Artificial Sequence
  derived and/or modified sequence opt5 from neuraminidase__InfluenzaA__ACA33539
augaaccccuaccagaagaucauuaccaucggcagcauuuccaucgccauugggaucaucucucugaugcuccaaauuggaaauaucauuagcaucugggcuucccacucuauucagacaggcagccagaaccauacggggaucugcaaucagagaauuaucaccuaugagaacuccacaugggugaaucacaccuacgucucuaucaacaauacaaacguuguggccggaaaagacaagaccagcgugacacuggcgggcaauuccagccuuuguucuauuuccgggugggcuaucuauaccaaagauaacagcauucggaucggaucuaagggcgacgucuucgugauucgcgaaccuuuuaucuccugcagccaucuggaguguagaacguucuuucucacccaaggcgcccugcuuaaugauaaacacucuaacgggacaguuaaggaccgguccccguaccgcgcccugaugagcugcccccucggagaagcuccuucccccuauaauucuaaguucgagagcguggccugguccgcuagcgccugucaugauggcaugggguggcugaccaucggaauuucuggcccugacaacggggcggucgccgugcugaaauacaauggaaucauuacagaaaccaucaaguccuggaaaaagcggauucucagaacgcaggagagcgagugcguuugugugaacggcucuugcuuuacaaucaugaccgauggccccagcaacggggcugccuccuauaaaaucuucaagauugaaaagggaaaagucacaaagucuaucgagcugaaugcuccuaacuuuuacuacgaagaguguagcugcuauccggacaccggcaccgugaugugugugugccgcgauaauuggcacggguccaacagacccugggucagcuucaaucagaaccuugacuaccagauuggauauaucugcucuggcguuuuuggggauaauccucggcccaaagacggaaagggcuccuguaacccugugacaguggauggcgccgacggggucaaaggauucagcuacaaguauggcaaugggguguggauuggacgcacgaaaucuaacagacugcggaagggcuuugagaugaucugggaccccaauggguggaccgauacagacuccgauuucagcguuaagcaagacguggucgcgauuaccgauugguccggcuacucuggcagcuuugugcagcacccggaacucacaggacuggacugcauccgcccuuguuucuggguugagcuugugagagggcugccccgggaaaacaccacgaucuggacauccggaucuagcauuuccuucugcggcgucgauagcgacaccgccaauuggucuuggccugauggggcugagcuccccuuuaccaucgacaaauga

SEQ ID NO: 199414 - RNA, 1413 nt, Artificial Sequence
  derived and/or modified sequence opt5 from neuraminidase__InfluenzaA__ACA33540
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuuuauuacgaagaguguagcugcuacccggacaccggcaccgugaugugugugugccgcgauaacuggcacggguccaauagacccugggucagcuucaaccagaaucuugacuaucagauuggauacaucugcucuggcguuuuuggggauaacccucggcccaaagacggaaagggcuccuguaauccugugacaguggauggcgccgacggggucaaaggauucagcuauaaguacggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuauucuggauccuuugugcagcacccggaacucacaggccuggacugcauccgcccuuguuucuggguugagcuugugagagggcugccccgggaaaauaccacgaucuggacauccggaucuagcauuuccuucugcggcgucgauagcgacaccgccaacuggucuuggccugauggggcugagcuccccuuuaccaucgacaaauga

SEQ ID NO: 199415 - RNA, 1413 nt, Artificial Sequence
  derived and/or modified sequence opt5 from neuraminidase__InfluenzaA__ACA33582
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuuuauuacgaagaguguagcugcuacccggacaccggcaccgugaugugugugugccgcgauaacuggcacggguccaauagacccugggucagcuucaaccagaaucuugacuaucagauuggauacaucugcucuggcguuuuuggggauaacccucggcccaaagacggaaagggcuccuguaauccuaugacaguggauggcgccgacggggugaaaggauucagcuauaaguacggcaacggggucuggauuggacgcacgaaaucuaauagacugcggaagggcuuugagaugaucugggaccccaacggguggaccgauacagacuccgauuucagcgugaagcaagacguuguggcgauuaccgauugguccggcuauucuggauccuuuguccagcacccggaacucacaggccuggacugcauccgcccuuguuucuggguggagcuuguuagagggcugccccgggaaaauaccacgaucuggacauccggaucuagcauuuccuucugcggcguggauagcgacaccgccaacuggucuuggccugauggggcugagcuccccuuuaccaucgacaaauga

SEQ ID NO: 199416 - RNA, 1413 nt, Artificial Sequence
  derived and/or modified sequence opt5 from neuraminidase__InfluenzaA__ACA33622
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcggauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuuuauuacgaagaguguucuugcuacccggacaccggcaccgugaugugugugugccgcgauaauuggcacgggagcaacagacccugggucuccuucaaucagaaccuugacuaucagauuggauacaucugcagcggcguuuuuggggauaauccucggcccaaagacggaaagggcucuuguaacccugugacaguggauggcgccgacggggucaaaggauucuccuauaaguacggcaaugggguguggauuggacgcacgaaaagcaacagacugcggaagggcuuugagaugaucugggaccccaauggguggaccaacacagauucugacuucuccguuaagcaagauguggucgcgauuaccgacuggagcggcuauuccggaucuuuugugcagcacccggaacucacaggccuggauugcauccgcccuuguuucuggguugagcuugugagagggcugccccgggaaaauaccacgaucuggacaagcggauccucuauuagcuucugcggcgucgacuccgauaccgccaacuggagcuggccugacggggcugagcuccccuuuaccaucgauaaauga

SEQ ID NO: 199417 - RNA, 1413 nt, Artificial Sequence; identical to SEQ ID NO: 199093
  derived and/or modified sequence opt5 from neuraminidase__InfluenzaA__ACA96522

SEQ ID NO: 199418 - RNA, 1362 nt, Artificial Sequence
  derived and/or modified sequence opt5 from neuraminidase__InfluenzaA__ACC55274
augaaccccaaucagaagaucauuaccaucggcagcgugucccugacaauugccacggucugcuuccucaugcaaaucgcuauucuggccaugaccguuacacuucacuuuagacagaacgaguguucuaucagcgcgaauagccagguggugccuugcgaaccgaccacagagaaagaagucuguucuaaggugguugacuaccggagcugguccaaaccccagugccaaaucaccggguucgcuccuuuuucuaaggauaacagcauucgccuguccgccggaggcgacaucuggauuacaagagagcccuaugugagcugugauaccucuaaaugcuaccaguucgcccucgggcagggaacgacccuggacaaugaacauuccaacggcacaauccacgaucggauuccucaucgcacccuucugaugaaugagcucgggguccccuuucaccugggaacaagacagguguguaucgcuugguccucuuccagcugccaugacggcaaggccuggcugcacguuugugugaccggcgaugaccggaacgcuacggccucuuucauuuauaaugggaugcucgucgauuccaucggaagcuggucccaaaacauccugcgcacacaggagucugaaugcguguguauuaauggcagcugcaccguggucaugacagacggguccgcgagcggaaaggccgauaccagaauccuuuuuguuaaagagggcaagauugugcacaucucuccucuguccgggagcgcucagcauauugaagagugcucuuguuacccgcgguaucccaacgugcgcugcgucuguagagacaauuggaaaggaagcaaccggccugugaucgauaucaauaugaccgacuacuccauugacucuagcuauguuugcuccggccucgugggcgauacaccccgcaacgaggacucuagcuccagcucuaacuguagagauccuaaugaggaacgggggaaccccggagucaagggcugggccuucgacuccggggaugacguguggaugggacgcacgaucagcagagauucccggucuggcuacgaaaccuuuagaguuauugggggauggacaaccgcuaauagcaaaucccagacaaaccgccaagugaucgucgacaauaacaauuggucuggcuacagcggcauuuucuccguggagcacaagagcugcaucaaccgguguuuuuaugucgaacugaucagagggcgcccgaaggagacccgggugugguggacgucuaauuccauuguuguguucugcggaacaagcggcaccuacgggaccggaucuuggccugauggcgccaacaucaauuuuaugcccauuuga

SEQ ID NO: 199419 - RNA, 1413 nt, Artificial Sequence; identical to SEQ ID NO: 199353
  derived and/or modified sequence opt5 from neuraminidase__InfluenzaA__ACC61967

SEQ ID NO: 199420 - RNA, 1413 nt, Artificial Sequence
  derived and/or modified sequence opt5 from neuraminidase__InfluenzaA__ACD11077
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagucaccacaucuaugacccuggccggcaacagcucccuuugcccuauucgggggugggcgaucuacagcaaggacaauucuauucgcaucggauccaaaggcgauguguucguuauuagagaaccguuuaucagcuguucucaccuggagugccggacguucuuucucacccagggcgcucugcuuaacgacaagcauuccaaugggacagugaaagaucgcagccccuauagagcccugaugucuuguccuaucggagaagcccccuccccuuacaacagccgguucgaguccgucgcuuggucugccagcgcuugccacgacggcaugggguggcucaccauuggaaucuccggccccgaugacggggccguggcgguucugaaguauaauggaauuaucacagaaaccauuaagagcuggcgcaaacagauccugagaacgcaggagucugagugugugugcgucaacggcuccuguuuuacaaucaugaccgauggcccuagcgacgggccggccucuuaccggauuuucaagaucgaaaaaggaaagauuacaaaaagcaucgagcucgaugcucccaacucccauuaugaagagugcucuuguuacccugacaccggcaccgugaugugcgugugccgcgauaauuggcacgggagcaacagacccugggucuccuuuaaucaaaaccuggacuaccagauuggauauaucuguagcggcguuuucggggauaauccucggcccaaggacggaaagggcucuugcgacccggugaacguggauggcgccgacggggucaaaggauuuuccuaccgcuauggcaaugggguguggauuggaagaacaaagagcaacaauucucggaaaggcuucgagaugaucugggauccuaacggguggacggacaccgauuccaauuuucuuguuaagcaggacguggucgcuaugacagauuggagcggcuacuccggaucuuucgugcagcaccccgaacugaccggccucgacuguaugcgcccuugcuuuuggguugagcugaucagagggcggcccagagagaaaacaaccauuuggacgagcggauccucuaucagcuucuguggcgugaacuccgauacagucaauuggagcuggcccgacggggccgaacuuccucugaccauugauaaguga

SEQ ID NO: 199421 - RNA, 1413 nt, Artificial Sequence
  derived and/or modified sequence opt5 from neuraminidase__InfluenzaA__ACD11078
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugcugaaguauaauggaauuaucacagaaaccauuaagagcuggcgcaaacagauccugagaacgcaggagucugaguguguuugcgugaacggcuccuguuuuacaaucaugaccgacggcccuagcgaugggccggccucuuaccggauuuucaagaucgaaaaaggaaagauuacaaaaagcaucgagcucgacgcucccaacucccauuaugaagagugcucuuguuacccugauaccggcaccgucaugugcgugugccgcgacaauuggcacgggagcaacagacccuggguguccuuuaaucaaaaccuggauuaccagauuggauauaucuguagcggcgucuucggggacaauccucggcccaaggacggaaagggcucuugcgauccgguuaacguggacggcgccgauggggugaaaggauuuuccuaccgcuauggcaauggggucuggauuggaagaacaaagagcaacucuucccggaaaggcuucgagaugaucugggacccuaauggguggacggauaccgacagcaacuuucuugugaagcaggauguuguggcuaugacagacugguccggcuacucuggcagcuucguccagcaccccgaacugaccggacucgauuguaugcgcccuugcuuuuggguggagcugaucagagggcggcccagagagaaaacaaccauuuggacguccggaucuagcaucuccuucuguggcguuaauagcgacacagugaacuggucuuggcccgauggggccgaacuuccucugaccauugacaaguga

SEQ ID NO: 199422 - RNA, 1413 nt, Artificial Sequence
  derived and/or modified sequence opt5 from neuraminidase__InfluenzaA__ACD11079
augaaccccaaucagaagaucauuaccaucggcagcauuugcauggccaucgggauuaucucccugauccuccaaauuggaaacaucauuucuaucugggugagccacuccauucagacaggcucucagaaucauacggggaucuguaaccagagaauuaucaccuacgagaauagcacaugggucaaccaaaccuauguuaauaucuccaacacaaaugugguggcuggaaaagacaccacaucuaugacccuggccggcaacagcucccuuugcccuauucgggggugggcgaucuacagcaaggauaauucuauucgcaucggauccaaaggcgacgucuucgugauuagagaaccguuuaucagcuguucucaccuggagugccggacguucuuucucacccagggcgcucugcuuaacgauaagcauuccaaugggacaguuaaagaccgcagccccuauagagcccugaugucuuguccuaucggagaagcccccuccccuuacaacagccgguucgaguccguggcuuggucugccagcgcuugccacgauggcaugggguggcucaccauuggaaucuccggccccgacgauggggccgucgcggugauuaaguauaauggaaucauuacagaaaccaucaagagcuggcgcaaacagauccugagaacgcaggagucugaguguguuugcgugaacggcuccuguuuuacaauuaugaccgacggcccuagcgaugggccggccucuuaccggaucuucaagauugaaaaaggaaagaucacaaaaagcauugagcuggacgcucccaacucccauuaugaagagugcucuuguuacccugauaccggcaccgucaugugcgugugccgcgacaauuggcacgggagcaacagacccuggguguccuuuaaucaaaaccucgauuaccagaucggauauauuuguagcggcgucuucggggacaauccucggcccaaggacggaaagggcucuugcgauccgguuaacguggacggcgccgauggggugaaaggauuuuccuaccgcuauggcaauggggucuggaucggaagaacaaagagcaacucuucccggaaaggcuucgagaugaucugggacccuaauggguggacggauaccgacagcaacuuucuggugaagcaggauguuguggcuaugacagacugguccggcuacucuggcagcuucguccagcaccccgaacuuaccggacuggauuguaugcgcccuugcuuuuggguggagcucauuagagggcggcccagagagaaaacaaccaucuggacguccggaucuagcauuuccuucuguggcguuaauagcgacacagugaacuggucuuggcccgauggggccgaacugccucuuaccaucgacaaguga

SEQ ID NO: 199423 - RNA, 1413 nt, Artificial Sequence; identical to SEQ ID NO: 199054
  derived and/or modified sequence opt5 from neuraminidase__InfluenzaA__ACD56116

SEQ ID NO: 199424 - RNA, 1413 nt, Artificial Sequence; identical to SEQ ID NO: 199054
  derived and/or modified sequence opt5 from neuraminidase__InfluenzaA__ACD56127

SEQ ID NO: 199425 - RNA, 1410 nt, Artificial Sequence; identical to SEQ ID NO: 198908
  derived and/or modified sequence opt5 from neuraminidase__InfluenzaA__ACD56261

SEQ ID NO: 199426 - RNA, 1410 nt, Artificial Sequence
  derived and/or modified sequence opt5 from neuraminidase__InfluenzaA__ACD56272
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcgugcccuuucaucucgggaccaagcaggucugcauugccuggucuagcuccagcugucacgauggaaaagccuggcugcaugugugcguuacaggcgacgauaagaacgcuaccgccucuuucaucuacaauggcagacuuguggacuccauugucagcuggucuaaagagauccugcggacccaggaauccgagugugugugcauuaacgggacauguacgguggucaugaccgauggaagcgcuuccggcaaggccgacacaaaaauccucuuuaucgaggaagggaagauuguucacaccucuacacugagcggauccgcgcaacacguggaggaaugcagcugcuauccucgcuaccccggcgugagaugugucugccgggauaauuggaaggggucuaaccgcccuaucguggacauuaacaucaaagacuacuccauuguuagcagauauguguguucuggacuugucggcgauacgccccggaagaaugacagcuccucuagcucccauugccuggauccgaacaaugaggaaggcgggcacggagugaaaggcugggccuucgacgaugggaacgacguuuggaugggacgcaccaucagcgagaagucuagauccggcuacgagacauuuaaagugaucgaaggguggagcaauccuaacucuaagcuccagauuaaucggcaggucaucguggaucgcggaaacagauccggcuauagcggcauuuucuccgucgaggggaaaucuuguaucaaucggugcuuuuacguggaacugauuagaggacgcaaggaggaaaccgagguucuguggaccagcaacuccaucguggucuucuguggcacaucugggaccuauggaacaggcagcuggcccgacggggcugauauuaaucucaugccuaucuga

SEQ ID NO: 199427 - RNA, 1413 nt, Artificial Sequence
  derived and/or modified sequence opt5 from neuraminidase__InfluenzaA__ACD56283
augaaccccaaucagaagaucauuaccaucggcagcauuuccauggccaucgggauuaucucucugaugcuccaaaucggaaacauuaucagcauuugggcuucccacucuauccagacaggcagccagaaucauacggggauuugcaaccagagaaucauuaccuacgagaauagcacaugggugaaccacaccuaugucucuaucaauaacacaaauguuguggccggaaaagacaagaccagcgugacacuggcgggcaacuccagccuuuguucuaucuccgggugggcuauuuacaccaaagauaauagcauccggauuggaucuaagggcgacgucuucgugauccgcgaaccuuuuauuuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaaucucuggcccugacaauggggcggucgccgugcugaaauauaacggaauuaucacagaaaccauuaaguccuggaaaaagagaauccuccggacgcaggagagcgagugcguuugugugaacggcucuugcuuuacaauuaugaccgauggccccagcaauggggcugccuccuacaaaaucuucaagaucgaaaagggaaaagucacaaagucuauugagcugaacgcuccuaauuuucacuaugaagaguguagcugcuacccggacaccggcaccgugaugugugugugccgcgauaacuggcacggguccaauagacccugggucagcuucaaccagaaucuugacuaccagaucggauauauuugcucuggcguuuuuggggauaacccucggcccaaagacggaaagggcuccuguaauccugugacaguggauggcgccgacggggucaaaggauucagcuacaaguauggcaacgggguguggaucggacgcacgaaaucuaauagacugcggaagggcuuugagaugauuugggaccccaacggguggaccgauacagacuccgauuucagcguuaagcaagacguggucgcgaucaccgauugguccggcuacucuggauccuuugugcagcauccggaacucacaggccuggacugcauucgcccuuguuucuggguugagcuugugagagggcugccccgggaaaauaccacgaucuggacauccggaucuagcaucuccuucugcggcgucgauagcgacaccgccaacuggucuuggccugauggggcugagcuccccuuuaccauugacaaauga

SEQ ID NO: 199428 - RNA, 1410 nt, Artificial Sequence
  derived and/or modified sequence opt5 from neuraminidase__InfluenzaA__ACD56305
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccugaggugguugaguaucggaacugguccaaaccccagugccaaaucaccggguucgcgccuuuuucuaaggauaauagcauucgccucuccgcuggaggcgacaucugggugacgagagaacccuacgucucuugugauccugggaaaugcuaucaguucgcccugggacagggcaccacacuugacaacaagcacagcaaugauaccauccaugaccggauuccgcaccgcacacugcucaugaacgagcugggggugcccuuucaucugggaaccagacagguuuguguggccugguccucuagcuccugccacgauggcaaggcuuggcuccacgucugugugacgggcgacgauaaaaaugccacagcuagcuucaucuacgacgggcggcugguggauucuauuggauccuggagccaaaacauccuucgcacccaggaaucugagugcgucuguauuaauggcacaugcaccguugugaugaccgacggguccgccagcggcagagcggauacacggauccuguuuaucgaggaaggaaagauugugcauaucuccccucucucugggagcgcccagcacgucgaggaaugcuccuguuauccccgcuacccugacgugagaugcauuugucgggacaacuggaaaggaagcaaucgccccguuaucgauauuaacauggaggacuauucuaucgauuccagcuacgugugcucuggccuggucggcgacacgccgagaaacgaugaccggagcuccaauucuaacugucgcgauccuaauaacgaaagagggaaucccggagugaagggcugggcuuucgacaacggggaugacguuuggaugggacggaccaucagcaaagaucuuagauccggcuacgagacauuuaaggugauugggggauggagcaccccuaauucuaagucccagaucaaccgccaagucauuguggacagcaauaacuggucuggcuauuccggcaucuucagcgucgaggggaaauccugcauuaaucgguguuuuuacguggaacugaucagaggacgccagcaggagacacggguuugguggaccucuaacagcauuguggucuucugcggcacguccgggacauauggaaccggcucuuggcccgacggggccaauaucaacuuuaugcccaucuga

SEQ ID NO: 199429 - RNA, 1410 nt, Artificial Sequence
  derived and/or modified sequence opt5 from neuraminidase__InfluenzaA__ACD56316
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccugaggugguugaguaucggaacugguccaaaccccagugccaaaucaccggguucgcgccuuuuucuaaggauaauagcauucgccucuccgcuggaggcgacaucugggugacgagagaacccuacgucucuugugauccugggaaaugcuaucaguucgcccugggacagggcaccacacuugacaacaagcacagcaaugauaccauccaugaccggauuccgcaccgcacacugcucaugaacgagcugggggugcccuuucaucugggaaccagacagguuuguguggccugguccucuagcuccugccacgauggcaaggcuuggcuccacgucugugugacgggcgacgauaaaaaugccacagcuagcuucaucuacgacgggcggcugauggauucuauuggauccuggagccaaaacauccuucgcacccaggaaucugagugcguguguauuaauggcacaugcaccgucguuaugaccgacggguccgccagcggcagagcggauacacggauccuguuuaucgaggaaggaaagauugugcauaucuccccucucucugggagcgcccagcacguggaggaaugcuccuguuauccccgcuacccugacgucagaugcauuugucgggacaacuggaaaggaagcaaucgccccgugaucgauauuaacauggaggacuauucuaucgauuccagcuacguuugcucuggccuggugggcgacacgccgagaaacgaugaccggagcuccaauucuaacugucgcaauccuaacaaugaaagagggaaccccggagucaagggcugggcuuucgauaauggggacgauguguggaugggacggaccaucagcaaagaccuuagauccggcuacgagacauuuaagguuauugggggauggagcaccccuaacucuaagucccagaucaaucgccaagugauugucgauagcaacaauuggucuggcuauuccggcaucuucagcguggaggggaaacggugcauuaacagauguuuuuacgucgaacugauccgcggacggcagcaggagacaagagugugguggaccuccaauucuauuguuguguucugcggcacgagcgggacauauggaaccggcuccuggcccgacggggccaacaucaauuuuaugcccaucuga

SEQ ID NO: 199430 - RNA, 1410 nt, Artificial Sequence
  derived and/or modified sequence opt5 from neuraminidase__InfluenzaA__ACD56327
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccuagcaaaugccaccaguucgcccuggggcagggaaccacacuugagaacaagcauuccaauggcaccaagcacgaccggaucccgcaucgcacacugcucaugaacgaacuggggguccccuuucaccugggaaccaaacagguguguguugcuuggucuagcuccagcugccacgauggcaaggccuggcuccaugugugugucacgggcgacgauagaaaugcuacagccucuuucauuuaugggggacggcugguggacuccaucgugagcuggucucaaaacauucuucgcacccaggaguccgagugcgucuguaucaauggcacaugcaccguugugaugaccgaugggagcgcguccggcagagccgacacacggauucuguuuaucaaagaaggaaagaucgugcacauuucuccucucagcggguccgcucagcauaucgaggaaugcagcuguuacccccgcuauccugaugucagaugcauuugucgggacaacuggaaaggaucuaaucgccccgugaucgauauuaacauggaggacuacuccaucgacagcucuuauguuugcagcggccuggugggcgauacgccgagaaacgacgauuccucuagcaauuccaacugucgggacccuaauaacgaacgcgggaaucccggagucaagggcugggccuucgauaacggggacgauguguggaugggaagaaccaucagcaaggacucucgguccggcuacgagacauuuaaaguuauugggggauggagcaccccuaauucuaagucccaggugaacagacaagucaucguggauagcaauaacugguccggcuacucuggcauuuucagcgucgaggggaaauccugcaucaaucgcuguuuuuauguggaacuuauucggggaagaccccaggagacacgcguuugguggaccucuaacagcaucguggucuucugcggcacguccgggacauacggaaccggcagcuggcccgacggggcuaauauuaacuuuaugccuaucuga

SEQ ID NO: 199431 - RNA, 1410 nt, Artificial Sequence
  derived and/or modified sequence opt5 from neuraminidase__InfluenzaA__ACD85190
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccaaaucaccggguucgcgccuuuuucuaaagauaauagcauucgccucuccgcuggaggcgacaucugggugacgagagagcccuacgucucuugugauccugggaagugcuaucaguucgcccugggacagggcaccacacuugacaacaagcacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacgugugugucacgggcgacgauaaaaaugccacagcuagcuucauuuacgacgggcggcugguggauucuaucggauccuggagccaaaacauucuucgcacccaggagucugaaugcguguguaucaauggcacaugcaccgucguuaugaccgacggguccgccagcggcagagcggauacacggauccuguuuauugaggagggaaaaaucgugcauauuuccccucucucugggagcgcccagcacguggaagagugcuccuguuauccccgcuacccugacgucagaugcaucugucgggacaacuggaagggaagcaaucgccccauuaucgauaucaacauggaagacuauucuauugauuccagcuacgugugcucuggccugguuggcgacacgccgagaaacgaugaccggagcuccaauucuaacugucgcaauccuaacaaugagagagggaaccccggagugaaaggcugggcuuucgauaauggggacgaugucuggaugggacggaccaucagcaaggaccuuagauccggcuacgaaacauuuaaggugauugggggauggagcaccccuaacucuaaaucccagaucaaucgccaaguuauuguggauagcaacaauuggucuggcuauuccggcaucuucagcgucgaggggaaguccugcauuaaccgguguuuuuacguggagcugaucagaggacgccagcaggaaacacgggucugguggaccucuaauagcaucgugguuuucugcggcacguccgggacauauggaaccggcucuuggcccgacggggccaacauuaauuuuaugcccaucuga

SEQ ID NO: 199432 - RNA, 1410 nt, Artificial Sequence
  derived and/or modified sequence opt5 from neuraminidase__InfluenzaA__ACD85201
augaaccccaaucagaagaucauuaccaucggcagcgugucccugacaauugccacggucugcuuccucaugcaaaucgcuauucugguuaccacagugacccuucacuuuaaacagcaugagugugacucuccugccagcaaccaggugaugccgugcgaacccaucaucauugagagaaauaucacagaaauugucuaccugaacaauaccacaaucgagaaggaaauuuguccuaaagugguugaguaucggaacugguccaagccccagugccaaaucaccggguucgcgccuuuuucuaaagauaauagcauucgccucuccgcuggaggcgacaucugggugacgagagagcccuacgucucuugugauccugggaagugcuaucaguucgcccugggacagggcaccacacuugacaacaagcacagcaaugauaccauccaugaccggauuccgcaccgcacacugcucaugaacgaacugggggugcccuuucaucugggaaccagacagguuuguaucgccugguccucuagcuccugccacgauggcaaggcuuggcuccacgugugugucacgggcgacgauaaaaaugccacagcuagcuucauuuacgacgggcggcugguggauucuaucuccagcuggucucaaaacauucuucgcacccaggaguccgaaugcguguguaucaauggaacaugcaccgucguuaugaccgacggcagcgccuccgggagagcggauacacggauccuguuuauugaggagggaaaaaucgugcauauuucuccucucagcggcuccgcccagcacguggaagagugcagcuguuauccccgcuacccugacgucagaugcaucugucgggacaacuggaaggggucuaaucgccccgugauugauaucaacauggaagacuauuccaucgauagcucuuacguuugcagcggacuggugggcgacacgccgagaaacgaugaccgguccucuaauagcaacugucgcaauccuaacaaugagagaggcaaccccggggucaaaggaugggcuuucgauaauggcgacgauguguggauggggcggaccauuuccaaggaccuuagaagcggauacgaaacauuuaagguuaucggcggguggucuaccccuaacuccaaaagccagauuaaucgccaagugaucgucgauucuaacaauugguccggauauagcggcauuuucuccguggagggcaagucuugcaucaaccgguguuuuuacgucgagcugauuagagggcgccagcaggaaacacgggugugguggaccagcaauuccaucguuguguucugcggaacgucuggcacauaugggaccggaagcuggcccgacggcgccaacaucaauuuuaugcccauuuga

SEQ ID NO: 199433 - RNA, 1410 nt, Artificial Sequence
  derived and/or modified sequence opt5 from neuraminidase__InfluenzaA__ACD85212
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucaaggaaauuguguaccugaacaauacaaccaucgagaaagaaauuuguccugaggucguggaguaucggaacugguccaagccccagugccaaaucacaggguucgcuccuuuuucuaaagauaauagcauucgccucuccgccggaggcgacaucuggguuaccagagaacccuacgugucuugugauccugggaagugcuaucaguucgcccugggacagggcacgacccuugacaacaagcacagcaaugggacaauccaugaucggauuccgcaccgcacccugcucaugaacgagcugggaguccccuuucaucugggcacaaaacagguguguguugcuugguccucuagcuccugccacgacggcaaggccuggcuccacgugugugucaccggggaugacagaaaugcuacggccagcuucaucuacgauggacggcugguggacucuauuggcuccuggagccaaaacauccuucgcacacaggaaucugagugcguguguauuaaugggaccugcacagucguuaugaccgauggauccgcgagcggcagagccgacacccggauccuguuuaucaaagaggggaagauugugcauaucuccccucucucuggaagcgcucagcacauugaagagugcuccuguuauccccgcuacccugaugugagaugcaucugucgggacaacuggaaaggcagcaaucgccccgucauugacaucaacauggaagauuauucuaucgacuccagcuacgugugcucuggccugguuggggauacaccgagaaacgacgauagcuccucuaauagcaacugucgggacccuaauaacgagcgcggaaaucccggcgugaaggggugggccuucgauaacggagacgaugucuggaugggcagaacgauuaauaaggacucccggagcggguacgaaaccuuuaaagugaucggaggcuggucuacaccuaacuccaagagccagguuaauagacaagugauugucgauaacaauaacuggucuggcuauuccgggaucuucagcguggagggaaaauccugcauuaaucgcuguuuuuacgucgagcuuauccggggcagaccccaggaaacccgcgugugguggacaucuaacagcauuguuguguucugcgggaccuccggaacguauggcacagggucuuggcccgacggcgcuaauaucaacuuuaugccuaucuga

SEQ ID NO: 199434 - RNA, 1410 nt, Artificial Sequence
  derived and/or modified sequence opt5 from neuraminidase__InfluenzaA__ACD85223
augaaccccaaucagaagaucauuaccaucggcagcgugucccugacaauugccacggcuugcuuccucaugcaaaucgccauucuggucaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccuaaagucguggaguaucggaacugguccaagccccagugccaaaucaccggguucgcuccuuuuucuaaagauaauagcauucgccucuccgccggaggcgacaucuggguuacgagagagcccuacgugucuugugauccugggaagugcuaucaguucgcccugggacagggcaccacacuugacaacaagcacagcaaugauaccauccaugaccggauuccgcaccgcacacugcucaugaacgaacuggggguccccuuucaucugggaaccagacagguguguaucgcuugguccucuagcuccugccacgauggcaaagccuggcuccacguuugugugacgggcgacgauaagaaugcuacagccagcuucauuuacgacgggcggcuggucgauucuaucggauccuggagccaaaacauucuucgcacccaggagucugaaugcguguguaucaauggcacaugcaccguggucaugaccgacggguccgcgagcggcagagccgauacacggauccuguuuauugaggagggaaaaaucguucauauuuccccucucucugggagcgcucagcacguggaagagugcuccuguuauccccgcuacccugacgugagaugcaucugucgggacaacuggaagggaagcaaucgccccauuaucgauaucaacauggaagacuauucuauugauuccagcuacgucugcucuggccuggugggcgacacgccgagaaacgaugaccggagcuccaauucuaacugucgcaauccuaacaaugagagagggaaccccggaguuaaaggcugggccuucgauaauggggacgauguguggaugggacggaccaucagcaaggaccuuagauccggcuacgaaacauuuaaggucauugggggauggagcaccccuaacucuaaaucccagaucaaucgccaagugauuguugauagcaacaauuggucuggcuauuccggcaucuucagcguggaggggaaguccugcauuaaccgguguuuuuacgucgagcugaucagaggacgccagcaggaaacacgggugugguggaccucuaauagcaucgucguguucugcggcacguccgggacauauggaaccggcucuuggcccgacggggcuaacauuaauuuuaugcccaucuga

SEQ ID NO: 199435 - RNA, 1410 nt, Artificial Sequence
  derived and/or modified sequence opt5 from neuraminidase__InfluenzaA__ACD85234
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccgacggagauaucuggguuacgagagaacccuacgugucuugugacccuggcaaaugcuaucaguucgcccuggggcagggaaccacacuugauaacaagcacagcaauggcaccauccaugaccggauuccgcaccgcacacugcucaugaacgagcuggggguccccuuucaucugggaaccaaacagguguguguugcuugguccucuagcuccugccacgauggcaaggccuggcuccacgugugugucacgggcgacgauagaaaugcuacagccagcuucaucuacgacgggcggcugguggauucuauuggauccuggagccaaaacauccuucgcacccaggaaucugagugcguguguauuaauggcacaugcaccgucguuaugaccgacggguccgcgagcggcagagccgauacacggauccuguuuaucaaggagggaaaaauugugcauaucuccccucucucugggagcgcucagcacauugaagagugcuccuguuauccccgcuacccugacgugagaugcaucugucgggacaacuggaagggaagcaaucgccccgucauugauaucaacauggaagacuauucuaucgauuccagcuacgugugcucuggccugguuggcgacacgccgagaaacgaugacagcuccucuaauagcaacugucgggauccuaauaacgagcgcgggaaucccggagugaaaggcugggccuucgacaacggggaugacgucuggaugggaagaaccauuuccaaggaucuucggagcggcuacgaaacauuuaaggugaucgggggauggucuaccccuaauuccaaaagccagguuaacagacaagugauugucgacaauaacaauuggucuggcuauuccggcaucuucagcguggaggggaaguccugcauuaaccgcuguuuuuacgucgagcugauccggggaagaccccaggaaacacgcgugugguggaccucuaauagcauuguuguguucugcggcacguccgggacauauggaaccggcucuuggcccgacggggcuaacaucaauuuuaugccuaucuga

SEQ ID NO: 199436 - RNA, 1410 nt, Artificial Sequence
  derived and/or modified sequence opt5 from neuraminidase__InfluenzaA__ACD85245
augaaccccaaucagaagaucauuaccaucggcagcgugucccugauuaucgccacagucugcuuccucaugcaaauugcuauccugguuacgaccgugacacuucacuuuaaacagcaugagugugacucuccugccagcaaccaggugaugccgugcgaacccaucauuaucgagagaaauauuaccgaaaucgucuaccugaacaauacaaccauugagaaggaaaucuguccucgggugguugaguaucgcaacugguccaaaccccagugccaaauuacaggguucgcgccuuuuucuaaggauaauagcaucagacucuccgcuggaggcgacaucugggugacccgggagcccuacgucucuugugauccugggaaaugcuaucaguucgcccugggacagggcacgacccuugacaacaagcacagcaaugauacaauucaugaccgcaucccgcacagaacccugcucaugaacgaacugggggugcccuuucaucugggaacacggcagguuuguauugccugguccucuagcuccugccacgauggcaaggcuuggcuccacguguguaucaccggcgacgauaaaaaugccacggcuagcuucauuuacgacgggcgccuggucgauucuaucggauccuggagccaaaacauccuuagaacacaggagucugaaugcguguguauuaaugggaccugcacaguggucaugaccgacggcuccgccagcggacgggcggauacccgcauccuguuuauugaggagggcaagaucguucauauuuccccucucucugggagcgcccagcacguggaagagugcuccuguuaucccagauacccuggagugcggugcaucugucgcgacaacuggaaaggcagcaauagacccgucguggacaucaacauggaagauuauucuauugacuccagcuacguuugcucuggccuggugggggauacaccgcggaacgacgaucgcagcuccaauucuaacuguagaaauccuaacaaugagcggggaaaccagggcgucaaggggugggcuuucgacaauggagaugacguguggaugggcagaacgaucagcaaagaucuucgcuccggguacgaaaccuuuaagguuauuggaggcuggagcacacccaacucuaagucccaaaucaauagacaggugauugucgacagcgaugaccggucuggcuauuccgggaucuucagcguggagggaaaauccugcauuaaccgcuguuuuuacgucgagcugauccggggcagaaagcaggaaacccgcgugugguggacaucuaauagcaucguuguguucugcgggaccuccggaacguauggcacagggucuuggccugacggcgccaacauuaauuuuaugcccaucuga

SEQ ID NO: 199437 - RNA, 1410 nt, Artificial Sequence
  derived and/or modified sequence opt5 from neuraminidase__InfluenzaA__ACD85454
augaaccccaaucagaagaucauuaccaucggcagcgugucccugacaauuucuacgaucggguucuuuaugcaaaccgccauucucaucacaaccgucacacugcacuucaaacaguacgaguuuaacagcccuccgaauaaccagguuaugcuuugcgaacccaccaucauugagagaaauaucacagaaauuguguaucugaccaacacgaccaucgagaaggaaauuuguccuaaacucgcugaguaccggaauugguccaagccccagugcgacaucacaggauucgccccuuuuucuaaagauaacagcauucgccuguccgcgggcggggacaucugggugaccagagagcccuaugucucuugugauccugacaagugcuaccaauucgcucuuggacagggcacaacccugaauaacgugcauagcaaugauacgguucggaaccgcacaccguauagaacccuccugaugaaugaacugggggugcccuuucaccucggaacaaagcaggucuguaucgccugguccucuagcuccugccaugacggcaaagccuggcugcacguguguauuaccggcgaugacaagaacgcuaccgccagcuucaucuacaaugggcggcuuguugauucuauuguguccuggagcaaagagauccugcgcacacaggaaucugagugcgucuguauuaacggaacgugcaccguggugaugacagacggcuccgcuagcgggaaggccgauaccaaaauccucuuuaucgaggaaggaaagauuguccauacauccacccugucuggcagcgcgcaacacguugaggaauguuccugcuauccuagauaccccggggugcggugcgugugucgcgacaacuggaagggaagcaauagaccuaucgucgauauuaacaucaaagaccacucuauuguguccagcuacguuugcucuggccuugugggcgacacgccccggaagaaugauagcuccucuagcucccauugucuggacccgaacaaugaggaagggggacacggcgucaaagggugggccuucgaugacggaaacgauguguggaugggccgcacaaucagcgagaagucuagacucggguaugagaccuuuaaaguuaucgaaggaugguccaauccuaagagcaaacugcagauuaaccgccaggugaucgucgaccggggcaauagaucuggcuacuccgggauuuucagcguggagggaaaguccugcaucaaccgguguuuuuaugucgaacugauuagaggccgcaaggaggaaaccgaggugcucuggacaucuaauagcaucguuguguucugcgggaccuccggaacauacggcacggggucuuggcccgauggcgcugacauuaaccugaugccuaucuga

SEQ ID NO: 199438 - RNA, 1410 nt, Artificial Sequence
  derived and/or modified sequence opt5 from neuraminidase__InfluenzaA__ACD85465
augaaccccaaucagaagaucauuaccaucggcagcgugucccugacaauuucuacgaucggguucuuuaugcaaaccgccauucucaucacaaccgucacacugcacuucaaacaguacgaguuuaacagcccuccgaauaaccagguuaugcuuugcgaacccaccaucauugagagaaauaucacagaaauuguguaucugaccaacacgaccaucgagaaggaaauuuguccuaaacucgcugaguaccggaauugguccaagccccagugcgacaucacaggauucgccccuuuuucuaaagauaacagcauucgccuguccgcgggcggggacaucugggugaccagagagcccuaugucucuugugauccugacaagugcuaccaauucgcucuuggacagggcacaacccugaauaacgugcauagcaaugauacgguucgggaccgcacaccguauagaacccuccugaugaacgaacugggggugcccuuucaccucggaacaaagcaggucuguaucgccugguccucuagcuccugccaugauggcaaagccuggcugcacguguguauuaccggcgacgauaagaaugcuaccgccagcuucaucuacaacgggcggcuuguugacucuauuguguccuggagcaaagagauccugcgcacacaggaaucugagugcgucuguauuaauggaacgugcaccguggugaugacagauggcuccgcuagcgggaaggccgacaccaaaauccucuuuaucgaggaaggaaagauuguccauacauccacccugucuggcagcgcgcaacacguugaggaauguuccugcuauccuagauaccccggggugcggugcgugugucgcgauaacuggaagggaagcaacagaccuaucgucgacauuaauaucaaagaccacucuauuguguccagcuacguuugcucuggccuugugggcgauacgccccggaagaacgacagcuccucuagcucccauugucuggauccgaauaacgaggaagggggacacggcgucaaagggugggccuucgacgauggaaaugacguguggaugggccgcacaaucagcgagaagucuagacucggguaugagaccuuuaaaguuaucgaaggaugguccaacccuaagagcaaacugcagauuaaucgccaggugaucgucgaucggggcaacagaucuggcuacuccgggauuuucagcguggagggaaaguccugcaucaaucgguguuuuuaugucgaacugauuagaggccgcaaggaggaaaccgaggugcucuggacaucuaacagcaucguuguguucugcgggaccuccggaacauacggcacggggucuuggcccgacggcgcugauauuaaucugaugccuaucuga

SEQ ID NO: 199439 - RNA, 1410 nt, Artificial Sequence
  derived and/or modified sequence opt5 from neuraminidase__InfluenzaA__ACD85487
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaacagcaagcugcagaucaaucgccaggugauugucgaccggggaaacagaucuggcuacuccggcaucuucagcguggaggggaaauccuguauuaaucggugcuuuuaugucgaacugaucagaggacgcaaggaggaaaccgaggugcucuggaccucuaacagcauuguuguguucuguggcacauccgggaccuacggaacaggcucuuggcccgauggggcugacaucaaucugaugccuaucuga

SEQ ID NO: 199440 - RNA, 1410 nt, Artificial Sequence
  derived and/or modified sequence opt5 from neuraminidase__InfluenzaA__ACD85498
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggcccgacggggcugauaucaaucugaugccuaucuga

SEQ ID NO: 199441 - RNA, 1410 nt, Artificial Sequence
  derived and/or modified sequence opt5 from neuraminidase__InfluenzaA__ACD85509
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucggaaccgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuauuguguccuggagcaaagagauccugcgcacacaggaaucugagugugucugcauuaacgggacguguaccguggugaugacagacggauccgcuagcggcaaggccgauaccaaaauccucuuuaucgaggaagggaagauuguccauacauccacccugucuggaagcgcgcaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcagccgcggggucaaaggaugggccuucgaugacggcaacgauguguggauggggagaacaaucucugagaagucccggcucggauaugagaccuuuaaaguuaucgaaggcuggagcaauccuaagucuaaacugcagauuaaccgccaggugaucgucgacagagggaaucgguccggauacagcggcauuuucuccguggagggcaagucuuguaucaacagaugcuuuuaugucgaacugauucgcgggcggaaggaggaaaccgaggugcucuggacaagcaauuccaucguuguguucuguggaaccucuggcacauacgggacgggaagcuggcccgauggcgcugacauuaaccugaugccuaucuga

SEQ ID NO: 199442 - RNA, 1410 nt, Artificial Sequence
  derived and/or modified sequence opt5 from neuraminidase__InfluenzaA__ACD85520
augaaccccaaucagaagaucauuaccaucggcagcgugucccugauuaucucuacaauuggguucuuuaugcaaacggccauccucaucaccacagucacccugcacuucaaacaguacgaguuuaacagcccuccgaauaaccagguuaugcuuugcgaacccacaauuaucgagagaaauauuaccgaaaucguguaucugacaaacaccacgauugagaaggaaaucuguccuaaacucgcugaguaccggaauugguccaagccccagugcgacauuaccggauucgccccuuuuucuaaagauaacagcauccgccuguccgcgggcggggacaucugggugacaagagagcccuaugucucuugugauccugacaagugcuaccaauucgcucuuggacagggcaccacacugaauaacgugcauagcaaugauaccguucgggaccgcacgccguauagaacacuccugaugaacgaacugggggugcccuuucaccucggaaccaagcaggucuguauugccugguccucuagcuccugccaugauggcaaagccuggcugcacguguguaucacaggcgacgauaagaaugcuaccgccagcuucauuuacaacgggcggcuuguugacucuaucguguccuggagcaaagagauucugcgcacccaggaaucugagugcgucuguaucaauggaacaugcacgguggugaugaccgauggcuccgcuagcgggaaggccgacacaaaaauccucuuuauugaggaaggaaagaucguccauaccuccacacugucuggcagcgcgcaacacguugaggaauguuccugcuauccuagauaccccggggugcggugcgugugucgcgauaacuggaagggaagcaacagaccuauugucgacaucaauauuaaagaccacucuaucguguccagcuacguuugcucuggccuugugggcgauacgccccggaagaacgacagcuccucuagcucccauugucuggauccgaauaacgaggaagggggacacggcgucaaagggugggccuucgacgauggaaaugacguguggaugggccgcaccaucagcgagaagucuagacucggguaugagacauuuaaaguuauugaaggaugguccaacccuaagagcaaacugcagaucaaucgccaggugauugucgaucggggcaacagaucuggcuacuccgggaucuucagcguggagggaaaguccugcauuaaucgguguuuuuaugucgaacugaucagaggccgcaaggaggaaaccgaggugcucuggaccucuaacagcauuguuguguucugcgggacauccggaaccuacggcacagggucuuggcccgacggcgcugauaucaaucugaugccuaucuga

SEQ ID NO: 199443 - RNA, 1410 nt, Artificial Sequence; identical to SEQ ID NO: 199438
  derived and/or modified sequence opt5 from neuraminidase__InfluenzaA__ACD85553

SEQ ID NO: 199444 - RNA, 1410 nt, Artificial Sequence
  derived and/or modified sequence opt5 from neuraminidase__InfluenzaA__ACD85564
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaacagcucaucugaccaacacgaccaucgagaaggaaauuugcccuaaacucgccgaguaucggaauugguccaagccccagugugacaucacaggguucgcgccuuuuucuaaagauaacagcauucgccuguccgcuggaggcgacaucugggugaccagagagcccuacgugucuugcgauccugacaaguguuaucaauucgcccuugggcagggaacaacccugaauaacguccacagcaaugauacggugcgggaccgcacaccguacagaacccuccugaugaacgaacugggcguucccuuucaucucgggacaaaacaggugugcaucgccugguccucuagcuccugucacgauggaaaggcuuggcugcaugucugcauuaccggcgacgauaagaaugccaccgcuagcuucaucuauaacggccggcuuguggacucuauuguuuccuggagcaaagagauccugcgcacacaggaaucugagugugugugcauuaaugggacguguaccgucgugaugacagauggauccgccagcggcaaggcggacaccaaaauccucuuuaucgaggaagggaagauugugcacacauccacccugucuggaagcgcccaacacgucgaggaaugcuccugcuacccuagauaucccggcguucggugugugugccgcgauaacuggaaggggagcaacagaccuaucguggacauuaauaucaaagaccauucuauugucuccagcuacguguguucuggacuuguuggcgauacgccccggaagaacgacagcuccucuagcucccacugccuggauccgaauaacgaggaaggcgggcauggagugaaaggcugggcuuucgacgaugggaaugacgucuggaugggacgcacaaucagcgagaagucuagacucggcuacgagaccuuuaaagugaucgaagggugguccaacccuaagagcaaacugcagauuaaucggcagguuaucguggaucgcggaaacagaucuggcuauuccggcauuuucagcgucgaggggaaguccuguaucaaucggugcuuuuacguggaacugauuagaggacgcaaggaggaaaccgagguccucuggacaucuaacagcaucgugguuuucuguggcaccuccgggacauauggaacgggcucuuggcccgacggggccgauauuaaucugaugccuaucuga

SEQ ID NO: 199445 - RNA, 1410 nt, Artificial Sequence
  derived and/or modified sequence opt5 from neuraminidase__InfluenzaA__ACD85575
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaaccauaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggccugacggggcugauaucaaucugaugcccaucuga

SEQ ID NO: 199446 - RNA, 1410 nt, Artificial Sequence
  derived and/or modified sequence opt5 from neuraminidase__InfluenzaA__ACD85586
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaaugggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcgcggagucaaaggcugggccuucgacgaugggaaugacguguggaugggaagaacaaucagcgagaagucucggcucggcuaugagaccuuuaaaguuaucgaagggugguccaacccuaagagcaaacugcagaccaaucgccaggugauugucgauagaggaaaccggucuggcuacuccggcaucuucagcguggaggggaaguccuguauuaauagaugcuuuuaugucgaacugauccgcggacggaaggaggaaacagaggugcucuggaccucuaacagcauuguuguguucuguggcacauccgggacguacggaaccggcucuuggcccgacggggcugauaucaaucugaugccuauuuga

SEQ ID NO: 199447 - RNA, 1410 nt, Artificial Sequence
  derived and/or modified sequence opt5 from neuraminidase__InfluenzaA__ACD93582
augaaccccaaucagaagaucauuaccaucggcagcgugucccugacaauuucuacgaucugcuucuuuaugcaaauugccauccucgcuaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgccgaguaccggaauugguccaagccccagugugacaucaccggguucgcgccuuuuucuaaagauaacagcauucgccuguccgcuggaggcgacaucugggugacaagagagcccuaugucucuugcgauccugacaaguguuaccaauucgcccuugggcagggaaccacacugaauaacgugcauagcaaugauaccguucggggccgcacgccguauagaacacuccugaugaacgaacugggggugcccuuucaccucggaaccaagcaggucugcaucgccugguccucuagcuccugucaugacggcaaggcuuggcugcacgugugcauuacaggcgaugacaaaaaugccaccgcuagcuucaucuacaacgggcggcuuguugauucuauuguguccuggagcaaagagauccugcgcacccaggaaucugagugugucugcauuaauggaacauguacgguggugaugaccgacggcuccgccagcgggaaggcggauacaaaaauccucuuuaucgaggaaggaaagauuguccauaccuccacacugucuggcagcgcccaacacguugaggaaugcuccugcuauccuagauaccccggggugcggugugugugccgcgacaacuggaagggaagcaacagaccuaucgucgauauuaauaucaaagaccacucuauuguguccagcuacguuuguucuggccuugugggcgacacgccccggaagaacgauagcuccucuagcucccauugccuggacccgaauaacgaggaagggggacacggcgucaaagggugggcuuucgaugacggaaaugauguguggaugggccgcaccaucagcgagaagucuagacucggguaugagacauuuaaaguuaucgaaggaugguccaacccuaagagcaaacugcagauuaaucgccaggugaucgucgacaagggcaaccggucuggcuacuccgggauuuucagcguggagggaaaguccuguaucaauagaugcuuuuaugucgaacugauucggggcagaaaagaggaaaccgaggugcucuggaccucuaacagcaucguuguguucugugggacauccggaaccuacggcacagggucuuggcccgauggcgccgacauuaaucugaugccuaucuga

SEQ ID NO: 199448 - RNA, 1410 nt, Artificial Sequence; identical to SEQ ID NO: 197736
  derived and/or modified sequence opt5 from neuraminidase__InfluenzaA__ACF09403

SEQ ID NO: 199449 - RNA, 1410 nt, Artificial Sequence; identical to SEQ ID NO: 198953
  derived and/or modified sequence opt5 from neuraminidase__InfluenzaA__ACF22151

SEQ ID NO: 199450 - RNA, 1410 nt, Artificial Sequence; identical to SEQ ID NO: 197119
  derived and/or modified sequence opt5 from neuraminidase__InfluenzaA__ACF22246

SEQ ID NO: 199451 - RNA, 1410 nt, Artificial Sequence; identical to SEQ ID NO: 197119
  derived and/or modified sequence opt5 from neuraminidase__InfluenzaA__ACF22257

SEQ ID NO: 199452 - RNA, 1410 nt, Artificial Sequence; identical to SEQ ID NO: 197119
  derived and/or modified sequence opt5 from neuraminidase__InfluenzaA__ACF22279

SEQ ID NO: 199453 - RNA, 1410 nt, Artificial Sequence; identical to SEQ ID NO: 197119
  derived and/or modified sequence opt5 from neuraminidase__InfluenzaA__ACF22290

SEQ ID NO: 199454 - RNA, 1410 nt, Artificial Sequence; identical to SEQ ID NO: 197119
  derived and/or modified sequence opt5 from neuraminidase__InfluenzaA__ACF22301

SEQ ID NO: 199455 - RNA, 1410 nt, Artificial Sequence; identical to SEQ ID NO: 197119
  derived and/or modified sequence opt5 from neuraminidase__InfluenzaA__ACF22312

SEQ ID NO: 199456 - RNA, 1410 nt, Artificial Sequence
  derived and/or modified sequence opt5 from neuraminidase__InfluenzaA__ACF22323
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccguaugaacccaucaucauugagagaaauaucacagaaauugucuaccugaacaauaccacaaucgagaaggaaauuugcccuaaagugguugaguaucggaacugguccaagccccagugucaaaucaccggguucgcgccuuuuucuaaagauaauagcauucgccucuccgcuggaggcgacaucugggugacgagagagcccuacgucucuugcgaucaugggaaguguuaucaguucgcccugggacagggcaccacacuugacaacaagcacagcaaugauaccauccaugaccggauuccucaccgcacacugcucaugaacgaacugggggugccguuucaucugggaaccagacagguuugcaucgccugguccuccucuuccugucacgauggcaaggcuuggcuccacgugugcauuacgggcgacgauaaaaaugccacagcuagcuucaucuacgacgggcggcuggucgauucuauuggauccuggagccaaaacauccuucgcacccaggagucugaaugugugugcaucaauggcacauguaccguggucaugaccgacggguccgccagcggcagagcggauacacggauucuguuuaucgaggagggaaaaauuguucauaucagcccccucucugggagcgcccagcacguggaagagugcuccugcuauccucgcuaccccggagugagauguauuugccgggacaacuggaagggcagcaaucgcccugucguggacaucaacauggaagauuacucuaucgacuccagcuauguuuguucuggccuggugggggauacgcccagaaacgacgaucggagcuccaauucuaacugccgcaauccgaacaaugagagaggaaaccagggcgucaaagggugggcuuucgacaauggagaugacguguggaugggccggaccauuagcaaggaucuuagauccggguacgaaacauuuaagguuaucggaggcuggagcaccccuaacucuaaaucccaaauuaaucgccaggugaucgucgacagcgauaaccggucuggcuauuccgggauuuucagcguggagggaaaguccuguaucaauagaugcuuuuacgucgagcugauucgcggccggaaacaggaaacaagagugugguggaccucuaacagcaucguuguguucugugggacguccggaacauauggcaccgggucuuggcccgacggcgccaauaucaacuuuaugccuauuuga

SEQ ID NO: 199457 - RNA, 1410 nt, Artificial Sequence; identical to SEQ ID NO: 197119
  derived and/or modified sequence opt5 from neuraminidase__InfluenzaA__ACF22334

SEQ ID NO: 199458 - RNA, 1410 nt, Artificial Sequence; identical to SEQ ID NO: 197119
  derived and/or modified sequence opt5 from neuraminidase__InfluenzaA__ACF22367

SEQ ID NO: 199459 - RNA, 1410 nt, Artificial Sequence
  derived and/or modified sequence opt5 from neuraminidase__InfluenzaA__ACF22378
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacuguaaaaauccgaacaaugagcgcggaaaccagggcgucaaggggugggcuuucgacaauggagaugacguguggaugggcagaaccauuagcaaggaucuucgguccggguaugaaacauuuaaaguuaucggaggcuggagcaccccuaacucuaagucccaaauuaauagacaggugaucgucgacagcgauaaccgcucuggcuacuccgggauuuucagcguggagggaaaauccugcaucaaucgguguuuuuaugucgagcugauuagaggccgcaagcaggaaacacgggugugguggaccucuaacagcaucguuguguucugcgggacguccggaacauacggcaccgggucuuggcccgacggcgccaauaucaacuuuaugccuauuuga

SEQ ID NO: 199460 - RNA, 1410 nt, Artificial Sequence
  derived and/or modified sequence opt5 from neuraminidase__InfluenzaA__ACF22389
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgugccuuuuucuaaagauaauagcauucgccucuccgcgggaggcgacaucugggucacgagagagcccuaugugucuugugaucaugggaagugcuaccaguucgcucugggacagggcaccacacuugacaacaagcacagcaaugauaccauccaugaccggauuccucaccgcacacugcucaugaacgaacuggggguuccguuucaucugggaaccagacagguguguaucgccugguccuccucuuccugccacgauggcaaagccuggcuccacgucuguauuacgggcgacgauaagaaugcuacagccagcuucaucuaugacgggcggcugguggauucuauuggauccuggagccaaaacauccuucgcacccaggagucugaaugcguguguaucaauggcacaugcaccgucguuaugaccgacggguccgcuagcggcagagccgauacacggauucuguuuaucgaggagggaaaaauugugcauaucagcccccucucugggagcgcgcagcacguggaagagugcuccuguuacccucgcuaucccggagucagaugcauuugucgggacaacuggaagggcagcaaucgcccugugguugacaucaacauggaagauuacucuaucgacuccagcuacgugugcucuggccuggucggggauacgcccagaaacgacgaucggagcuccaauucuaacugucgcaauccgaacaaugagagaggaaaccagggcgugaaagggugggccuucgacaauggagaugacguuuggaugggccggaccauuagcaaggaucuuagauccggguaugaaacauuuaaggugaucggaggcuggagcaccccuaacucuaaaucccaaauuaaucgccaggucaucguggacagcgauaaccggucuggcuacuccgggauuuucagcgucgagggaaaguccugcaucaauagauguuuuuauguggagcugauucgcggccggaaacaggaaacaagaguuugguggaccucuaacagcaucguggucuucugcgggacguccggaacauacggcaccgggucuuggcccgacggcgcuaauaucaacuuuaugccuauuuga

SEQ ID NO: 199461 - RNA, 1410 nt, Artificial Sequence
  derived and/or modified sequence opt5 from neuraminidase__InfluenzaA__ACF22400
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcugauggauucuauuggauccuggagccaaaacauccuucgcacccaggagucugaaugcgucuguaucaauggcacaugcaccguggugaugaccgacggguccgccagcggcagagcggauacacggauucuguuuaucgaggagggaaaaauuguccauaucagcccccucucugggagcgcccagcacguugaagagugcuccuguuacccucgcuaucccggagugagaugcauuugucgggacaacuggaagggcagcaaucgcccuguggucgacaucaacauggaagauuacucuaucgacuccagcuacgugugcucuggccugguuggggauacgcccagaaacgacgaucggagcuccaauucuaacugucgcaauccgaacaaugagagaggaaaccagggcgugaaagggugggcuuucgacaauggagaugacgucuggaugggccggaccauuagcaaggaucuuagauccggguaugaaacauuuaaggugaucggaggcuggagcaccccuaacucuaaaucccaaauuaaucgccagguuaucguggacagcgauaaccggucuggcuacuccgggauuuucagcgucgagggaaaguccugcaucaauagauguuuuuauguggagcugauucgcggccggaaacaggaaacaagagucugguggaccucuaacagcaucgugguuuucugcgggacguccggaacauacggcaccgggucuuggcccgacggcgccaauaucaacuuuaugccuauuuga

SEQ ID NO: 199462 - RNA, 1410 nt, Artificial Sequence; identical to SEQ ID NO: 199090
  derived and/or modified sequence opt5 from neuraminidase__InfluenzaA__ACF22411

SEQ ID NO: 199463 - RNA, 1413 nt, Artificial Sequence
  derived and/or modified sequence opt5 from neuraminidase__InfluenzaA__ACF33772
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuaucuacaccaaagauaacucuauucggaucggauccaagggcgacgucuucgugauucgcgagccguuuaucagcugcucucaucuggaguguaaaacguucuuucucacccaaggcgcccugcuuaaugauaagcacuccaacgggacaguuaaggacagaagccccuaucgggcccugaugucuugcccucucggagaagcucccuccccuuacaauagcaaauucgaguccguggccuggucugcuagcgccugucaugauggcaucggguggcugaccauuggaaucuccggccccgacaacggggcggucgccgugcugaaguauaacggaauuaucacaggcaccauuaaaagcuggaagaaacagauccuccgcacgcaggaaucugagugcguuuguaugaauggcuccugcuuuacaaucaugaccgaugggccuagcaacggagcugccucuuacaagauuuucaagaucgagaaaggcaaggugacaaaaagcauggaacugaaugcuccgaacuuuuauuacgaggaauguuccugcuaccccgacaccgggaccgucaugugugugugcagagauaauuggcacggaucuaaccggccuugggugagcuucaaucagaaccuugacuaucaaauuggcuacaucugcuccggggucuuuggagauaauccccgcccuaaggacggcgagggcagcuguaaccccguuacaguggauggggccaauggagugaaaggcuucucuuauaaguacgggaacggagucuggauuggcagaacgaaauccaaucggauccgcaagggguuugagaugauuugggacccgaacggcuggaccaauacagacagcgauuucucugugaagcaggacaucguugcgaucaccgauugguccggauauagcggcuccuuugugcagcacccugaacugacagggcucgacugcauuagacccuguuucugggucgagcuggugcggggacuuccucgcgaaaacaccacgaucuggacaucuggcagcuccauuucuuucugcgggguuaacagcgauaucgccaauugguccuggcccgacggagcugagcugcccuuuaccauugauaaauga

SEQ ID NO: 199464 - RNA, 1410 nt, Artificial Sequence
  derived and/or modified sequence opt5 from neuraminidase__InfluenzaA__ACF33778
augaaccccaaucagaagaucauuaccaucggcagcgugucccugacaauuucuacgaucugcuucuuuaugcaaauugccauccucaucaccacagucacccugcacuucaaacaguacgaguuuagcuccccuccgaacaaucagguuaugcuuugugaacccacaauuaucgagagaaacauuaccgaaaucguguaucugacaaauaccacgauugagaaggaaaucugcccuaaacucgcugaguaccggaacuggucuaagccccagugugacauuaccggguucgccccuuuuagcaaagauaauuccauccgccugucugcgggaggcgacaucugggugacaagagagcccuaugucagcugcgauccugacaaguguuaccaauucgcucuugggcagggaaccacacugaacaaugugcauuccaacgauaccguucacgaccggacgccguaucgcacacuccugaugaaugaacugggcauucccuuucaucucgggaccaaacaggugugcaucgccuggucuagcuccagcugucacgauggaaaggccuggcugcaugucugcgugacaggcgacgauaagaacgcuaccgccucuuucauuuacaauggcagacuuguugacuccaucgugagcuggucuaaagagauucugcggacccaggaauccgagugugucugcaucaacgggacauguacgguggugaugaccgauggaagcgcuuccggcaaggccgacacaaaaauccucuuuauugaggaagggaagaucguccacaccucuacacugagcggauccgcgcaaaauguugaggaaugcagcugcuauccucgcuaccccggcgugagaugugugugccgggauaacuggaaggggucuaaccgcccuauugucgacaucaauauuaaagacuacuccaucgugagcagauauguuuguucuggacuugugggcgauacgccccggaagaacgacagcuccucuagcucccacugccugaauccgaacaaugaggaaggcgggcauggagucaaaggcugggccuucgaugacgggaacgauguguggaugggacgcaccaucagcgagaagucuagauccggcuacgagacauuuaaaguuauugaaggguggagcaauccuaacucuaagcuccagaucaaucgccaggugauugucgaccggggaaacagauccggcuauagcggcaucuucuccguggaggggaaaucuuguauuaaucggugcuuuuacgucgaacugaucagaggacgcaaggaggaaaccgaggugcuguggaccagcaacuccauuguuguguucuguggcacaucugggaccuauggaacaggcagcuggcccgauggggcugacaucaaucucaugccuaucuga

SEQ ID NO: 199465 - RNA, 1410 nt, Artificial Sequence
  derived and/or modified sequence opt5 from neuraminidase__InfluenzaA__ACF33785
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaugugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgugcggacgccguaucgcacacuccugaugaacgaacugggcguccccuuucaucucgggaccaaacaggugugcaucgccugguccucuagcuccugucacgacggaaaggccuggcugcauguuugcgugacaggcgaugacaagaaugcuaccgccagcuucauuuacaacggcagacuugucgauucuaucguguccuggagcaaagacauucugcggacccaggagucugaaugugugugcaucaaugggacauguacggucguuaugaccgauggauccgcuagcggcaaggccgacacaaaaauucucuuuaucgaggaggggaagaucgugcacaccuccacacugucuggaagcgcgcaacacguggaagagugcuccugcuauccucgcuaccccggcgucagaugugugugccgggauaacuggaaggggagcaaccgcccuauuguugacaucaauauuaaagacuacucuaucguguccagcuaugucuguucuggacuugugggcgauacccccagaaagacggacagcuccucuagcucccauugccuggauccgaacaaugaagagggcgggcacggaguuaaaggcugggccuucgacgaugggaacgacguguggaugggacggacaauuagcgaaaagcuccgccugggcuacgagaccuuuaaagucaucgagggguggucuaauccuaacuccaagcugcagaucaauagacaggugauugucgaucggggaaaccgcagcggcuauucuggcaucuucuccguggaagggaaaagcuguauuaauagaugcuuuuacguugagcucauccggggaagaaaggaagagaccgaagugcuguggacauccaacucuauugucguguucuguggcaccagcgggacauauggaacgggcuccuggcccgacggggcugauaucaaucuuaugccuauuuga

SEQ ID NO: 199466 - RNA, 1413 nt, Artificial Sequence
  derived and/or modified sequence opt5 from neuraminidase__InfluenzaA__ACF33787
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggcgggcaauucuagccuuuguuccauuagcgggugggcuaucuacaccaaagauaacucuauucggaucggauccaagggcgacgucuucgugauucgcgagccguuuaucagcugcucucaucuggaguguaaaacguucuuucucacccaaggcgcccugcuuaaugauaagcacuccaacgggacaguuaaggacagaagccccuaucgggcccugaugucuugcccucucggagaagcucccuccccuuacaauagcaaauucgaguccguggccuggucugcuagcgccugucaugauggcaucggguggcugaccauuggaaucuccggccccgacaacggggcggucgccgugcugaaguauaacggaauuaucacaggcaccauuaaaagcuggaagaaacagauccuccgcacgcaggaaucugagugcguuuguaugaauggcuccugcuuuacaaucaugaccgaugggccuggaaacggcgcugccagcuacaagauuuucaagaucgagaaagggaaggugacaaaaucuauggaacugaaugcuccgaacuuucacuaugaggaauguagcugcuaccccgacaccggaaccgucaugugugugugcagagauaauuggcacggcuccaaccggccuugggugucuuucaaucagaaccuugacuaccaaauuggguauaucugcagcggagucuuuggcgauaauccccgcccuaaggacggcgagggguccuguaaccccguuacaguggauggagccaauggcgugaaaggguucagcuacaaguauggaaacggcgucuggauugggagaacgaaaucuaaucggauccgcaagggcuuugagaugauuugggacccgaacggauggaccaauacagacuccgauuucagcgugaagcaggacaucguugcgaucaccgauuggucuggcuacuccgggagcuuugugcagcauccugaacugacaggacucgacugcauuagacccuguuucugggucgagcuggugcggggccuuccuaaagaaaacaccacgaucuggacauccgggucuagcauuuccuucugcggaguuaacucuggcaucgccaauuggagcuggcccgauggggcugagcugcccuuuaccauugacaaguga

SEQ ID NO: 199467 - RNA, 1410 nt, Artificial Sequence; identical to SEQ ID NO: 198908
  derived and/or modified sequence opt5 from neuraminidase__InfluenzaA__ACF33798

SEQ ID NO: 199468 - RNA, 1410 nt, Artificial Sequence; identical to SEQ ID NO: 199081
  derived and/or modified sequence opt5 from neuraminidase__InfluenzaA__ACF41672

SEQ ID NO: 199469 - RNA, 1413 nt, Artificial Sequence; identical to SEQ ID NO: 199054
  derived and/or modified sequence opt5 from neuraminidase__InfluenzaA__ACF41683

SEQ ID NO: 199470 - RNA, 1410 nt, Artificial Sequence
  derived and/or modified sequence opt5 from neuraminidase__InfluenzaA__ACF41749
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagggauugucuaucugaacaauaccacaaucgaaaaggagauuuguccuaaagugguugaauaccggaacugguccaagccccagugccaaaucaccggauucgcgccuuuuucuaaagauaauagcauucgccucuccgcuggcggggacaucugggugacgagagagcccuaugucucuugugaucauggaaagugcuaccaguucgcccugggccaggggaccacacuugacaacaagcacagcaaugauaccauccaugaccggauuccucaccgcacacugcucaugaacgagcugggagugccguuucaucugggcaccagacagguuuguaucgccugguccuccucuuccugccacgauggcaaggcuuggcuccacguguguauuacgggggacgauaaaaaugccacagcuagcuucaucuaugacggacggcuggucgauucuauuggcuccuggagccaaaacauccuucgcacccaggaaucugagugcguguguaucaaugggacaugcaccguggucaugaccgacggauccgccagcggcagagcggauacacggauucuguuuaucgaagaggggaaaauuguucauaucagcccccucucuggaagcgcccagcacguggaggaaugcuccuguuacccucgcuaucccggcgugagaugcauuugucgggacaacuggaagggcagcaaucgcccugucguggacaucaacauggaggauuacucuaucgacuccagcuacguuugcucugggcuggugggagauacgcccagaaacgacgaucggagcuccaauucuaacugucgcaauccgaacaaugaaagaggcaaccagggggucaaaggaugggcuuucgacaauggcgaugacguguggauggggcggaccauuagcaaggaucuuagauccggauaugagacauuuaagguuaucggcggcuggagcaccccuaacucuaaaucccaaauuaaucgccaggugaucgucgacagcgauaaccggucuggguacuccggaauuuucagcguggaaggcaaguccugcaucaauagauguuuuuaugucgagcugauucgcgggcggaaacaggagacaagagugugguggaccucuaacagcaucguuguguucugcggaacguccggcacauacgggaccggcucuuggcccgacggagccaauaucaacuuuaugccuauuuga

SEQ ID NO: 199471 - RNA, 1410 nt, Artificial Sequence
  derived and/or modified sequence opt5 from neuraminidase__InfluenzaA__ACF41760
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucgggggaagugcuaccaguucgcccugggacagggcaccacacuugacaacaagcauagcaaugauaccauccacgaccgcauuccucauagaacacugcucaugaacgaacugggggugccguuucaccugggaacccggcagguuuguaucgccugguccuccucuuccugccaugauggcaaggcuuggcuccacguguguauuacgggcgacgauaaaaaugccacagcuagcuucaucuaugacgggcgccuggucgauucuauuggauccuggagccaaaacauccuuagaacccaggagucugaaugcguguguaucaauggcacaugcaccguggucaugaccgacggguccgccagcggacgggcggauacacgcauucuguuuaucgaggagggcaaaauuguucacaucagcccccucucugggagcgcccagcauguggaagagugcuccuguuacccuagauaucccggagugcggugcauuugucgcgacaacuggaagggcagcaauagaccugucguggacaucaacauggaagauuacucuaucgacuccagcuacguuugcucuggccuggugggggauacgccccggaacgacgaucgcagcuccaauucuaacuguagaaauccgaacaaugagcggggaaaccagggcgucaaagggugggcuuucgacaauggagaugacguguggaugggcagaaccauuagcaaggaucuucgcuccggguaugaaacauuuaagguuaucggaggcuggagcaccccuaacucuaaaucccaaauuaauagacaggugaucgucgacagcgauaaccggucuggcuacuccgggauuuucagcguggagggaaaguccugcaucaaucgcuguuuuuaugucgagcugauucggggcagaaaacaggaaacacgcgugugguggaccucuaacagcaucguuguguucugcgggacguccggaacauacggcaccgggucuuggcccgacggcgccaauaucaacuuuaugccuauuuga

SEQ ID NO: 199472 - RNA, 1410 nt, Artificial Sequence
  derived and/or modified sequence opt5 from neuraminidase__InfluenzaA__ACF41771
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucauuaccgacggguccgccagcggcagagcggauacacggauccuguuuauugaggagggaaaaaucguucauauuagcccccucucugggagcgcccagcacguggaagagugcuccuguuacccucgcuaucccggagugagaugcaucugucgggacaacuggaagggcagcaaucgcccugucguggacaucaacauggaagauuacucuauugacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccaucagcaaggaucuuagauccggguaugaaacauuuaagguuauuggaggcuggagcaccccuaacucuaaaucccaaaucaaucgccaggugauugucgacagcgauaaccggucuggcuacuccgggaucuucagcguggagggaaaguccugcauuaauagauguuuuuaugucgagcugauccgcggccggaaacaggaaacaagagugugguggaccucuaacagcaucguuguguucugcgggacguccggaacauacggcaccgggucuuggcccgacggcgccaauauuaacuuuaugccuaucuga

SEQ ID NO: 199473 - RNA, 1410 nt, Artificial Sequence; identical to SEQ ID NO: 197119
  derived and/or modified sequence opt5 from neuraminidase__InfluenzaA__ACF41793

SEQ ID NO: 199474 - RNA, 1410 nt, Artificial Sequence; identical to SEQ ID NO: 197119
  derived and/or modified sequence opt5 from neuraminidase__InfluenzaA__ACF41804

SEQ ID NO: 199475 - RNA, 1410 nt, Artificial Sequence; identical to SEQ ID NO: 197119
  derived and/or modified sequence opt5 from neuraminidase__InfluenzaA__ACF41826

SEQ ID NO: 199476 - RNA, 1365 nt, Artificial Sequence; identical to SEQ ID NO: 198743
  derived and/or modified sequence opt5 from neuraminidase__InfluenzaA__ACF41837

SEQ ID NO: 199477 - RNA, 1413 nt, Artificial Sequence
  derived and/or modified sequence opt5 from neuraminidase__InfluenzaA__ACF41881
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgagaauagcacaugggugaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaauccuccggacgcaggaguccgagugcgugugugucaauggcagcugcuuuacaauuaugaccgauggccccucuaacggggcugccagcuacaaaaucuucaagaucgaaaagggaaaagugacaaaguccauugagcugaaugcuccuaacuuucacuaugaagaguguucuugcuacccggacaccggcaccgugaugugugucugccgcgauaauuggcacgggagcaacagacccuggguuuccuucaaucagaaccuugacuaccagaucggauauauuugcagcggcguguuuggggauaauccucggcccaaagacggagagggcucuuguaacccugugacagucgauggcgccgacggggugaagggauucuccuacaaauauggcaaugggguuuggaucggacgcacgaaguccaacagacugcggaaaggcuuugaaaugauuugggaccccaauggguggaccgauacagacucugauuucuccgugaagcaagacgucguggcgaucaccgauuggagcggcuacuccggaucuuuuguucagcauccggagcucacaggccuggacugcauucgcccuuguuucuggguggaacuugucagagggcugccccgggagaacaccacgaucuggacaagcggauccucuaucagcuucugcggcgucaauuccgauaccgccaacuggagcuggccugacggggcugaacuccccuuuaccauugauaaguga

SEQ ID NO: 199478 - RNA, 1410 nt, Artificial Sequence; identical to SEQ ID NO: 198953
  derived and/or modified sequence opt5 from neuraminidase__InfluenzaA__ACF41892

SEQ ID NO: 199479 - RNA, 1410 nt, Artificial Sequence; identical to SEQ ID NO: 197351
  derived and/or modified sequence opt5 from neuraminidase__InfluenzaA__ACF41903

SEQ ID NO: 199480 - RNA, 1410 nt, Artificial Sequence
  derived and/or modified sequence opt5 from neuraminidase__InfluenzaA__ACF41914
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccuuggcgugagaugugucugccgggacaacuggaaggggagcaaucgccccaucguggauauuaacaucaaagacuacucuauuguuuccagcuauguguguucuggacuggucggcgacaccccuagaaagaaugauagcuccucuagcucccauugccucgaccccaacaaugaggaaggcgggcacggagugaaaggcugggccuucgaugacgggaacgauguuuggaugggacggacgaucagcgagaagcugcgcucuggcuacgagacauuuaaagugaucgaagggugguccaauccgaacagcaagcugcagauuaauagacaggucaucguggaccggggaaaccgcucuggcuauuccggcauuuucagcgucgaggggaaauccuguaucaauagaugcuuuuacguggaacucauucggggaagaaaggaggaaaccgagguucuguggaccucuaacagcaucguggucuucuguggcacauccgggaccuauggaacaggcucuuggccugauggggcugacauuaaucuuaugcccaucuga

SEQ ID NO: 199481 - RNA, 1413 nt, Artificial Sequence
  derived and/or modified sequence opt5 from neuraminidase__InfluenzaA__ACF41925
augaaccccaaucagaagaucauuaccaucggcagcauuuccauggccaucgggauuaucucucugauccuccaaauuggaaacaucauuagcaucugggcuucccacucuauucagacaggcagccagaaucauacggggaucugcaaccagagaauuaucaccuacgagaauagcacaugggugaaccaaaccuaugucaauaucaacaauacaaacguuguggccggaaaagacaagaccucugugacacuggcgggcaauagcucccuuuguccuauucgggggugggcuaucuacaccaaagauaacagcauucgcaucggaucuaagggcgacgucuucgugauuagagaaccguuuaucuccugcagccaccuggagugucggacguucuuucucacccagggcgcccugcuuaaugauaaacauucuaacgggacaguuaaggaccgcucccccuauagagcccugaugagcugcccucucggagaagcucccucuccuuacaauucccgguucgagagcguggccugguccgcuucugccugucacgauggcaugggguggcugaccaucggaauuagcggccccgacaacggggcggucgccgugcugaaguauaacggaaucauuacagaaaccaucaaauccuggaagaaacgcauucucagaacgcaggagagcgagugcguuugugugaauggcucuugcuuuacaaucaugaccgauggcccuuccaacggggcugccagcuaccggaucuucaagauugaaaaaggaaaggucacaaagucuaucgagcuggacgcuccgaauuaucauuacgaagaguguagcugcuaccccgauaccggcaccgugaugugugugugccgcgacaacuggcacggguccaauagaccuugggucucuuuuaaccagaaucuugauuaucaaauuggauacaucugcagcggcguuuucggggacaacccccggccuaaagauggagagggcuccuguaaucccgugacaguggacggcgccgacggggucaagggauuuagcuaucgcuacggcaacgggguguggauuggaagaacgaaaucuaaucggcugcgcaagggcuucgaaaugaucugggauccgaacggguggaccgacacagauuccgacuuuagcguuaaacaggauguggucgcgaugaccgacuggucuggcuauuccggauccuucgugcagcacccugagcucacaggccuggauugcaugagacccuguuuuuggguugaacuuauucgggggagaccucgcgagaauaccacgaucuggacauccggaucuagcaucuccuucugcggcgugaacucugacaccgccaauuggagcuggcccgauggggcugaacugcccuucaccauugacaaguga

SEQ ID NO: 199482 - RNA, 1413 nt, Artificial Sequence; identical to SEQ ID NO: 199481
  derived and/or modified sequence opt5 from neuraminidase__InfluenzaA__ACF41936

SEQ ID NO: 199483 - RNA, 1410 nt, Artificial Sequence
  derived and/or modified sequence opt5 from neuraminidase__InfluenzaA__ACF54392
augaaccccaaucagaagaucauuaccaucggcagcguuucccugacaacggccaccgcuugcuuccucacacaaauugccauccuggucaccacaguuacccuucacuuuaaacagcaugagugugacucuccugcgagcaaccaggugaugccgugcgaacccauuaucaucgagagaaauauuacagaaaucguguaccugaacaauaccacgauugagaaggaaaucuguccuaaagucguggaguaucggaacugguccaagccccagugccaaauuaccggguucgcuccuuuuucuaaagauaauagcauccgccucuccgccggaggcgacauuuggguuacaagagagcccuacgugucuugugauagcgggaagugcuaucaguucgcccugggacagggcaccacacuugacaacaagcacuccaaugauaccauccaugaccggaucccucaccgcacgcugcucaugaacgaacugggggucccguuucaucugggaacaagacagguguguauugcuuggucuagcuccagcugccacgauggcaaagccuggcuccacguuuguaucaccggcgacgauaagaaugcuacagccucuuucauuuacgacgggcggcugguggauuccaucggaagcuggucucaaaacauucuucgcacccaggaguccgaaugcgucuguaucaauggaaccugcacaguggugaugacggacgggagcgcguccggcagagccgauacccggauccuguuuauugaggagggcaaaaucguccauauuucuccccucagcggguccgcucagcacguugaagagugcagcuguuauccucgcuaccccggagugagaugcaucugucgggacaacuggaagggcucuaaucgcccuguggucgacauuaacauggaagauuauuccaucgacagcucuuacgugugcagcggccugguuggggauacacccagaaacgacgaucgguucuccaauucuaacugucgcaauccgaacaaugagagaggaaaccagggcgugaaagggugggccuuugacaauggagaugacgucuggaugggccggaccaucagcaaggaucuuagauccggguacgaaacauucaaggugauuggaggcuggagcaccccuaacucuaaaucccaaaucaaucgccagguuauuguggacagcgauaaccggucuggcuauuccgggaucuuuagcgucgagggaaaguccugcauuaauagauguuucuacguggagcugauccgcggccggaaacaggaaacgagagucugguggacaucuaacagcauugugguguuuugcgggaccuccggaaccuauggcacagggucuuggcccgacggcgcuaauaucaacuucaugccuaucuga

SEQ ID NO: 199484 - RNA, 1410 nt, Artificial Sequence; identical to SEQ ID NO: 197119
  derived and/or modified sequence opt5 from neuraminidase__InfluenzaA__ACF54403

SEQ ID NO: 199485 - RNA, 1410 nt, Artificial Sequence; identical to SEQ ID NO: 197119
  derived and/or modified sequence opt5 from neuraminidase__InfluenzaA__ACF54414

SEQ ID NO: 199486 - RNA, 1410 nt, Artificial Sequence; identical to SEQ ID NO: 197119
  derived and/or modified sequence opt5 from neuraminidase__InfluenzaA__ACF54425

SEQ ID NO: 199487 - RNA, 1410 nt, Artificial Sequence; identical to SEQ ID NO: 197119
  derived and/or modified sequence opt5 from neuraminidase__InfluenzaA__ACF54436

SEQ ID NO: 199488 - RNA, 1410 nt, Artificial Sequence
  derived and/or modified sequence opt5 from neuraminidase__InfluenzaA__ACF54447
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccaaacagguuuguaucgccugguccuccucuuccugccacgauggcaaggcuuggcuccacguguguauuacgggcgacgauaaaaaugccacagcuagcuucaucuaugacgggagacuggucgauucuauuggauccuggagccaaaacauccuucggacccaggagucugaaugcguguguaucaauggcacaugcaccguggucaugaccgacggguccgccagcggacgcgcggauacacggauucuguuuaucgaggagggcaagauuguucauaucagcccccucucugggagcgcccagcacguggaagagugcuccuguuacccuagauaucccggagugcgcugcauuuguagagacaacuggaaaggcagcaaucggccugucguggacaucaacauggaagauuacucuaucgacuccagcuacguuugcucuggccuggugggggauacgccccgcaacgacgauagaagcuccaauucuaacugucggaauccgaacaaugagcgcggaaaccagggcgucaaggggugggcuuucgacaauggagaugacguguggaugggcagaaccauuagcaaggaucuucgguccggguaugaaacauuuaaaguuaucggaggcuggagcaccccuaacucuaagucccaaauuaauagacaggugaucgucgacagcgauaaccgcucuggcuacuccgggauuuucagcguggagggaaaauccugcaucaaucgguguuuuuaugucgagcugauuagaggccgcaagcaggaaacacgggugugguggaccucuaacagcaucguuguguucugcgggacguccggaacauacggcaccgggucuuggcccgacggcgccaauaucaacuuuaugccuauuuga

SEQ ID NO: 199489 - RNA, 1410 nt, Artificial Sequence
  derived and/or modified sequence opt5 from neuraminidase__InfluenzaA__ACF54469
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguauggccugguccuccucuuccugccacgauggcaaggcuuggcuccacguguguaucacgggcgacgauaaaaaugccacagcuagcuucauuuaugacgggcggcuggucgauucuaucggauccuggagccaaaacauucuucgcacccaggagucugaaugcguguguaucaauggcacaugcaccguggucaugaccgacggguccgccagcggcagagcggauacacggauccuguuuauugaggagggaaaaaucguucauauuagcccccucucugggagcgcccagcacguggaagagugcuccuguuacccucgcuaucccggagugagaugcaucugucgggacaacuggaagggcagcaaucgcccugucguggacauuaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccaucagcaaggaucuuagauccggguaugaaacauuuaagguuauuggaggcuggagcaccccuaacucuaaaucccaaaucaaucgccaggugauugucgacagcgauaaccggucuggcuacuccgggaucuucagcguggagggaaaguccugcauuaauagauguuuuuaugucgagcugauccgcggccggaaacaggaaacaagagugugguggaccucuaacagcauuguuguguucugcgggacguccggaacauacggcaccgggucuuggcccgacggcgccaauaucaacuuuaugccuaucuga

SEQ ID NO: 199490 - RNA, 1410 nt, Artificial Sequence; identical to SEQ ID NO: 198784
  derived and/or modified sequence opt5 from neuraminidase__InfluenzaA__ACF54480

SEQ ID NO: 199491 - RNA, 1410 nt, Artificial Sequence
  derived and/or modified sequence opt5 from neuraminidase__InfluenzaA__ACF54502
augaaccccaaucagaagaucauuaccaucggcagcgugucccugacaauugccacggucugcuuccucaugcaaaucgcuauucuggccaccacaguuacccuucacuuuaaacagcaugagugugacucuccugcgagcaaccaggugaugccgugcgaacccaucaucauugagagaaauaucacagaaauuguguaccugaacaauaccacaaucgagaaggaaauuuguccugaggucguggaguaucggaacugguccaaaccccagugccaaaucaccggguucgcuccuuuuucuaaggauaauagcauucgccucuccgccggaggcgacaucuggguuacgagagaacccuacgugucuugugauccugggaaaugcuaucaguucgcccugggacagggcaccacacuugacaacaagcacagcaaugggaccauccaugaucggauuccgcaccgcacacugcucaugaacgagcugggagucuccuuucaucugggcaccaaacagguguguguugcuuggucuagcuccagcugccacgacggcaaggccuggcuccacgugugugucacgggggaugacagaaaugcuacagccucuuucaucuacgauggacggcugguggacuccauuggcagcuggucucaaaacauccuucgcacccaggaauccgagugcguguguauuaaugggacaugcaccgucguuaugaccgauggaagcgcguccggcagagccgacacacggauccuguuuaucaaggaggggaaaauugugcauaucucuccccucagcggauccgcucagcacauugaagagugcagcuguuauccucgcuaccccgaugugagaugcaucugucgggacaacuggaagggcucuaaucgcccugucauugacaucaacauggaagauuauuccaucgacagcucuuacgugugcagcggccugguuggggauacgcccagaaacgacgauuccucuagcaauuccaacugucgggacccgaauaacgagcgcggaaauccuggcgugaaagggugggccuucgauaacggagacgaugucuggaugggcagaaccauuaauaaggacagccggucuggguacgaaacauuuaaggugaucggaggcugguccacccccaacagcaaaucucagguuaauagacaagugauugucgauaacaauaacugguccggcuauagcgggaucuucuccguggagggaaagucuugcauuaaucgcuguuuuuacgucgagcuuauccggggcagaccucaggaaacacgcgugugguggaccagcaacuccauuguuguguucugcgggacgucuggaacauauggcaccgggagcuggcccgacggcgcuaauaucaacuuuaugcccaucuga

SEQ ID NO: 199492 - RNA, 1410 nt, Artificial Sequence; identical to SEQ ID NO: 199491
  derived and/or modified sequence opt5 from neuraminidase__InfluenzaA__ACF54513

SEQ ID NO: 199493 - RNA, 1410 nt, Artificial Sequence
  derived and/or modified sequence opt5 from neuraminidase__InfluenzaA__ACF54524
augaaccccaaucagaagaucauuaccaucggcagcgugucccugacaauugccacggucugcuucuuuaugcaaaucgcuauucucgccaccacaguuacccugcacuucaaacagcaugagugugacucuccugcgagcaaccaggugaugccgugcgaacccaucaucauugagagaaauaucacagaaauuguguaccuuaacaauaccacaaucgagaaggaaauuuguccugaggucguggaguaucggaacugguccaaaccccagugccaaaucaccggguuugcuccuuucucuaaggauaauagcauucgccuguccgccggaggcgacaucuggguuacgagagaacccuacgugucuugugauccugggaaaugcuaucaguuugcccucggacagggcaccacacuggacaacaagcacagcaaugggaccauccaugaucggauuccgcaccgcacacuucugaugaacgagcucggagucuccuuccaucugggcaccaaacagguguguguugcuuggucuagcuccagcugccacgacggcaaggccuggcugcacgugugugucacgggggaugacagaaaugcuacagccucuuuuaucuacgauggacggcucguggacuccauuggcagcuggucucaaaacauccugcgcacccaggaauccgagugcguguguauuaaugggacaugcaccgucguuaugaccgauggaagcgcguccggcagagccgacacacggauccuuuucaucaaggaggggaaaauugugcauaucucuccccugagcggauccgcucagcacauugaagagugcagcuguuauccucgcuaccccgaugugagaugcaucugucgggacaacuggaagggcucuaaucgcccugucauugacaucaacauggaagauuauuccaucgacagcucuuacgugugcagcggccucguuggggauacgcccagaaacgacgauuccucuagcaauuccaacugucgggacccgaauaacgagcgcggaaauccuggcgugaaagggugggccuuugauaacggagacgaugucuggaugggcagaaccauuaauaaggacagccggucuggguacgaaacauucaaggugaucggaggcugguccacccccaacagcaaaucucagguuaauagacaagugauugucgauaacaauaacugguccggcuauagcgggaucuuuuccguggagggaaagucuugcauuaaucgcuguuucuacgucgagcugauccggggcagaccucaggaaacacgcgugugguggaccagcaacuccauuguuguguuuugcgggacgucuggaacauauggcaccgggagcuggcccgacggcgcuaauaucaacuucaugcccaucuga

SEQ ID NO: 199494 - RNA, 1410 nt, Artificial Sequence
  derived and/or modified sequence opt5 from neuraminidase__InfluenzaA__ACF54535
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccaagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgagcugggcgugcccuuucaccucgggaccaaacaggucugcauugccugguccucuagcuccugucaugauggaaaggccuggcugcacgugugcaucacaggcgacgauaaaaaugcuaccgccagcuucauuuacaacggccggcuuguugacucuaucguguccuggagcaaggaaauucugcgcacccaggagucugaaugugucugcaucaaugggacauguacgguggugaugaccgauggauccgcuagcggcaaagccgacacaaagauccucuuuauugaggaggggaagaucguccauaccuccacacugucuggaagcgcgcaacacguugaagagugcuccugcuauccuagauaccccggcgugcggugugugugccgcgauaacuggaaagggagcaacagaccuauugucgacaucaauauuaaggaccacucuaucguguccagcuacguuuguucuggacuugugggcgauacgccccggaaaaacgacagcuccucuagcucccauugccuggauccgaauaacgaagagggcgggcacggagucaagggcugggccuucgacgaugggaaugacguguggaugggacgcaccaucagcgaaaaaucuagacucggcuaugagacauuuaagguuauugaggggugguccaacccuaaaagcaagcugcagaucaaucgccaggugauugucgaucggggaaacagaucuggcuacuccggcaucuucagcguggaagggaaguccuguauuaaucggugcuuuuaugucgagcugaucagaggacgcaaagaagagaccgaagugcucuggaccucuaacagcauuguuguguucuguggcacauccgggaccuacggaacaggcucuuggcccgacggggcugauaucaaucugaugccuaucuga

SEQ ID NO: 199495 - RNA, 1410 nt, Artificial Sequence; identical to SEQ ID NO: 197308
  derived and/or modified sequence opt5 from neuraminidase__InfluenzaA__ACF54557

SEQ ID NO: 199496 - RNA, 1410 nt, Artificial Sequence; identical to SEQ ID NO: 198953
  derived and/or modified sequence opt5 from neuraminidase__InfluenzaA__ACF54568

SEQ ID NO: 199497 - RNA, 1410 nt, Artificial Sequence
  derived and/or modified sequence opt5 from neuraminidase__InfluenzaA__ACF54579
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaucaccgacggauccgcuagcggcaaggccgauacaaaaauccucuuuauugaggaagggaagaucguucacaccuccacacugucuggaagcgcgcaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugauugaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggaccucuaacagcauuguggucuucuguggcacauccgggaccuauggaacaggcucuuggcccgauggggcugacaucaaucugaugccuaucuga

SEQ ID NO: 199498 - RNA, 1362 nt, Artificial Sequence
  derived and/or modified sequence opt5 from neuraminidase__InfluenzaA__ACF54601
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaucuauuaccuacaaaguuguggccggccaagacagcacauccgugauccugaccgggaacucuagccuuugcccuaucagaggaugggcuauucacuccaaggauaauggcauccggauuggcagcaaaggggacgucuucgugauccgcgagccguuuauuucuuguucccaucuggaaugcagaacauucuuucucacccagggagcccugcuuaacgauaagcacagccggggcacauucaaagaccgcucucccuauagagcgcugauguccuguccuguuggggaggcucccagcccuuacaauucucgguuugaauccguggccuggagcgccuccgcuugccaugauggaaugggcuggcucaccaucgggaucucuggacccgacgauggcgccgucgcugugcugaaguauaacggcauuaucacggagaccauuaagagcuggcgcaaaaauauccugagaacacaggaauccgaguguaccugcguuaacgggagcuguuucacaauuaugaccgacggaccuucugauggccucgccuccuacaagaucuuuaaaaucgagaaggggaaagugacaaagagcauugaacugaaugcgccgaacucucacuaugaggaaugcagcuguuaccccgacacgggaaaggucaugugcgugugccgggauaauuggcacggcuccaaccgcccuugggugucuuucgaccagaaccuugauuauaaaaucggguacauuuguagcggagucuuuggcgacaaucccagaccuaaggacggcaccggguccugcggacccguuagcgccgauggcgcuaacggggugaaaggauucucuuacaaguauggcaaugggguguggaucggccggacaaaauccgacagcucucgccauggauuugagaugauuugggauccgaacggcuggaccgagaccgacuccagauucagcaugcggcaagaugucguggccaugacagaccgcuccggguacucuggcagcuuuguucagcacccugaacugacgggacucgauuguaugagacccugcuucuggguggagcugauccgggggcuuccugaagagaaugcuauuuggaccuccggaucuaucaucagcuucuguggcgucaacuccgacacaguggauuggagcuggcccgacggggccgaacugcccuuuaccauugauaaguga

SEQ ID NO: 199499 - RNA, 1350 nt, Artificial Sequence
  derived and/or modified sequence opt5 from neuraminidase__InfluenzaA__ACG50700
augaaccccaaucagaagaucauuaccaucggcagcauuugcauggugaucgggauugucucccugaugcuccaaaucggaaacaugaucucuauuuggguuagccacuccauccagacaggcaaucagcaucaggccgagccuauuucuaacacgaauuuccugaccgaaaaagcuguggccagcgugacacuugcggggaacuccccgcugugucccaucucuggaugggcuguccacagcaaggacaauuccauuagaaucggcagcaaaggggauguguuuguuauucgggagccuuucaucucuugcucccaucucgaaugucgcaccuuuuuccugacacaaggagcccuucugaacgacaagcacagcaauggcaccgugaaagauagaucuccccaucggacacucauguccugcccugucggcgaggcccccagcccuuacaacucucgcuuugaauccguggcuuggagcgccuccgcuugucacgacgggaccucuuggcugacgaucggaauuagcggcccggauaauggggccguugcggugcugaaguauaacggaaucauuaccgacacaaucaaguccuggagaaauaacauucuccggacccaggagagcgagugcgccugugucaauggcucuugcuucacagugaugaccgaugggcccuccaacggacaggcuagcuacaaaaucuuuaagauggaaaaaggcaagguggucaaaucuguugagcuggacgccccuaacuaucacuacgaagaguguagcugcuaucccgaugcuuccgaggugacgugugugugccgcgacaauuggcauggcucuaacagaccuugggucagcuucaaucagaaccuugaauaccaaaucggguauauuugcuccggaguguuuggcgauaauccccggccgaacgacgggacaggaagcuguggcccuguuucuaccaauggggccuacggagugaagggcuucuccuuuaaguacggcaacggggucuggaucggacgcacaaaaagcaccaauucuagauccggcuucgagaugauuugggauagcaacggguggaccggaacagacuccucuuuuagcgugaagcaggacaucguugcgauuacggauugguccggcuauucugggagcuucgugcagcaccccgaacugaccggccucgacugcauccggccuuguuucugggucgagcugauccgcggaagacccaaagaauccacaauuuggaccagcgggucuuccaucagcuuuugcggcgucaauucugauacagugggaugguccuggcccgacggcgccgagcuuccuuucaccauugauaaguga

SEQ ID NO: 199500 - RNA, 1410 nt, Artificial Sequence; identical to SEQ ID NO: 199081
  derived and/or modified sequence opt5 from neuraminidase__InfluenzaA__ACG70145

SEQ ID NO: 199501 - RNA, 1410 nt, Artificial Sequence; identical to SEQ ID NO: 198908
  derived and/or modified sequence opt5 from neuraminidase__InfluenzaA__ACG70156

SEQ ID NO: 199502 - RNA, 1410 nt, Artificial Sequence
  derived and/or modified sequence opt5 from neuraminidase__InfluenzaA__ACG80407
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacucgcuaaguaccggaauugguccaaaccccagugugacauuaccggguucgccccuuuuucuaaggauaacagcauccgccuguccgcgggaggcgacaucugggugacaagagagcccuaugugucuugcgauccugacaaguguuaccaauucgcucuugggcagggaaccacacugaauaacguccauagcaaugauaccgcccggggccgcacgccguauagaacacuccugaugaacgagcugggggugcccuuucaccucggaaccaaacagguuugcauugccugguccucuagcuccugucaugacggcaaggcuuggcugcacgugugcaucacaggcgaugacaaaaaugccaccgcuagcuucauuuacaacgggcggcuugucgauucugugguuuccuggagcaaggaaauccugcgcacccaggagucugaaugugugugcauuaauggaacauguacggucgugaugaccgacggcuccgccagcggggaggcggauacaaaaauccucuuuaucgaggaaggaaagauugugcauaccuccacacugucuggcagcgcccaacacgucgaggaaugcuccugcuauccuagauaccccgggguucggugugugugccgcgacaacuggaagggaagcaacagaccuaucguggauauuaauaucaaagaccacucuauugucuccagcuacguguguucuggccuuguuggcgacacgccccggaagaacgauagcuccucuagcucccauugccuggacccgaauaacgaggaagggggacacggcgugaaagggugggcuuucgaugacggaaaugaugucuggaugggccgcaccaucagcgagaagucuagacucggguaugagacauuuaaagugaucgaaggaugguccaacccuaagagcaaacugcagauuaaucggcagguuaucguggaccgcggcaacagaucuggcuacuccgggauuuucagcgucgagggaaaguccuguaucaaucggugcuuuuauguggaacugauuagaggccgcaaggaggaaaccgagguccucuggaccucuaacagcaucgugguuuucugugggacauccggaaccuacggcacagggucuuggcccgauggcgccgacauuaaucugaugccuaucuga

SEQ ID NO: 199503 - RNA, 1410 nt, Artificial Sequence
  derived and/or modified sequence opt5 from neuraminidase__InfluenzaA__ACG80411
auggacagcaacuccaagaucauuaccaucggcucugugagccugacaauuuccacgaucugcuucuuuaugcagauugccauccucaucaccacagucacccugcacuucaaacaauacgaguuuaauucucccccuaacaaucagaugaugcuuugugaaccgacaauuaucgagagaaacauuaccgaaaucguuuaucugacaaauaccacgauugagaaggaaaucugccccaaacucgcugaguaccggaacuggagcaagccucagugugauauuaccggguucgcccccuuuuccaaagacaauucuauccgccugagcgcgggaggcgauaucugggugacaagagagccuuauguguccugcgaccccgauaaguguuaccaguucgcucuugggcaaggaaccacacugaacaauguccauagcaacgacaccgccggcgggcggacgccuuaucgcacacuccugaugaaugaacugggagugccguuucaccucggcaccaagcagguuugcauugccuggucuuccagcucuugucaugauggcaaggcuuggcugcacgugugcaucacaggggacgauaaaaacgccaccgcuuccuucauuuacgacggaagacuugucgauggcgugguuagcuggucuaaagagauccugcggacccaggaauccgagugugugugcauuaaugggacauguacggucgugaugaccgacggaagcgccuccggcgaggcggauacaaagauccucuuuaucgaagaggggaaaauugugcauaccucuacacugagcggauccgcccagcacgucgaagagugcagcugcuauccccgcuacccuggcguuagaugugugugccgggacaacuggaagggcucuaaucgccccaucguggacauuaacaucaaggaucacuccauugucagcucuuacguguguagcgggcuuguuggagacaccccucggaaaaacgauuccucuagcuccagccauugccuggaccccaauaacgaagagggcgggcacggagugaagggcugggcuuucgaugacgggaaugaugucuggaugggaagaacgaucucugagaaaucccgccucggcuaugaaacauuuaaggugaucgagggcuggagcaacccgaaaucuaagcugcaaauuaauagacagguuaucguggaccgggggaaccgcuccggauacagcggcauuuucuccgucgaagggaaaucuuguaucaauagaugcuuuuauguggagcugauucggggaagaaaggaagagaccgagguccucuggaccagcaacuccaucgugguuuucuguggcacaucugggaccuacggcacaggaagcuggccugauggcgccgacauuaaucugaugcccaucuga

SEQ ID NO: 199504 - RNA, 1407 nt, Artificial Sequence
  derived and/or modified sequence opt5 from neuraminidase__InfluenzaA__ACG80421
augaaccccauccagaagauuaucaccauuggcagcgugucccugacaaucucuacgauuugcuucuuuaugcaaaucgccauccucauuaccacagucacccugcacuucaaacaguacgaguuuaauagcccuccgaacaaucagaugaugcuuugugaacccacaaucauugagagaaacaucaccgaaauuguuuaucugacaaauaccacgaucgagaaggaaauuugcccuaaacucgcugaguaccggaacugguccaagccccagugugacaucaccggguucgccccuuuuucuaaagauaauagcauccgccuguccgcgggaggcgacauuugggugacaagagagcccuaugugucuugcgauccugacaaguguuaccaauucgcucuugggcagggaaccacacugaacaauguccauagcgauaccgcccgggaccgcacgccguauagaacacuccugaugaacgaacugggcgugcccuuucaccucgggaccaagcagguuugcaucgccugguccucuagcuccugucaugauggaaaggcuuggcugcacgugugcauuacaggcgacgauaaaaaugccaccgcuagcuucaucuacaacggccggcuugucgacucugugguuuccuggagcaaagagauucugcgcacccaggaaucugagugugugugcaucaaugggacauguacggucgugaugaccgauggauccgccagcggcgaggcggacacaaagauccucuuuauugaagaggggaaaaucgugcauaccuccacacugucuggaagcgcccaacacgucgaagagugcuccugcuauccuagauaccccggcguucggugugugugccgcgauaacuggaaggggagcaauagaccuauuguggacaucaacauuaaggaccacucuaucgucuccagcuacguguguucuggacuuguuggcgauacgccccggaaaaacgacagcuccucuagcucccauugccuggauccgaauaacgaagagggcgggcacggagugaagggcugggcuuucgacgaugggaaugacgucuggaugggacgcaccaucagcgagaaaucuagacucggcuaugaaacauuuaaggugauugaggggugguccaacccuaaaagcaagcugcagaucaaucggcagguuauuguggaucgcggaaacagaucuggcuacuccggcaucuucagcgucgaagggaaauccuguauuaaucggugcuuuuauguggagcugaucagaggacgcaaggaagagaccgagguccucuggaccucuaacagcauugugguuuucuguggcacauccgggaccuacggaacaggcucuuggcccgacggggccgauaucaaucugaugccuaucuga

SEQ ID NO: 199505 - RNA, 1407 nt, Artificial Sequence
  derived and/or modified sequence opt5 from neuraminidase__InfluenzaA__ACG80427
auggaccccaacagcaagaucauuaccaucggcuccgugucucugacaauuagcacgaucugcuucuuuaugcagauugccauccucaucaccacagucacccugcacuucaaacaauacgaguuuaauuccccuccgaacaaucagaugaugcuuugugaacccacaauuaucgagagaaacauuaccgaaaucguuuaucugacaaauaccacgauugagaaggaaaucugcccuaaacucgcugaguaccggaacuggucuaagccccagugugauauuaccggguucgccccuuuuagcaaagacaauuccauccgccugucugcgggaggcgauaucugggugacaagagagcccuaugugagcugcgacccugauaaguguuaccaguucgcucuugggcaaggaaccacacugaacaauguccauuccgacaccgcccgggaucgcacgccguauagaacacuccugaugaacgaacugggcgugcccuuucaccucgggaccaagcagguuugcauugccuggucuagcuccagcugucaugacggaaaggcuuggcugcacgugugcaucacaggcgaugacaaaaaugccaccgcuucuuucauuuacaacggccggcuugucgauuccgugguuagcuggucuaaagagauccugcgcacccaggaauccgagugugugugcauuaaugggacauguacggucgugaugaccgacggaagcgccuccggcgaggcggauacaaagauccucuuuaucgaagaggggaaaauugugcauaccucuacacugagcggauccgcccagcacgucgaagagugcagcugcuauccuagauaccccggcguucggugugugugccgcgacaacuggaaggggucuaauagaccuaucguggacauuaacaucaaggaucacuccauugucagcucuuacguguguagcggacuuguuggcgacacgccccggaaaaacgauuccucuagcuccagccauugccuggacccgaauaacgaagagggcgggcacggagugaagggcugggcuuucgaugacgggaaugaugucuggaugggacgcaccaucucugagaaauccagacucggcuaugaaacauuuaaggugaucgagggguggagcaacccuaaaucuaagcugcaaauuaaucggcagguuaucguggaccgcggaaacagauccggcuacagcggcauuuucuccgucgaagggaaaucuuguaucaaucggugcuuuuauguggagcugauuagaggacgcaaggaagagaccgagguccucuggaccagcaacuccaucgugguuuucuguggcacaucugggaccuacggaacaggcagcuggcccgauggggccgacauuaaucugaugccuaucuga

SEQ ID NO: 199506 - RNA, 1410 nt, Artificial Sequence
  derived and/or modified sequence opt5 from neuraminidase__InfluenzaA__ACG80437
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccaauuucauuuacaacggccggcuuguugauucuaucguguccuggagcaaagagauuuuucgcacccaggaaucugagugugucugcaucaacgggacauguacgguggugaugaccgacggauccgcuagcggcaaggccgauacaaaaauccuguucauugaggaagggaagaucguccauaccuccacacucucuggaagcgcgcaacacguugaggaaugcuccugcuaucccagauacccuggcgugcggugugugugccgcgacaauuggaaggggagcaacagacccauugucgauaucaauauuaaagaccacucuaucguguccagcuacguuuguucuggacuggugggcgacaccccucggaagaacgauagcuccucuagcucccauugccuugaccccaauaacgaggaaggcgggcacggagucaaaggcugggccuuugaugacgggaaugauguguggaugggacgcacgaucagcgagaagucuagauccggcuaugagacauucaaaguuauugaaggguggagcaacccgaagucuaaacugcagaucaaucgccaggugauugucgaccggggaaacagauccggcuacagcggcaucuuuuccguggaggggaagucuuguauuaaucggugcuucuaugucgaacucaucagaggacgcaaggaggaaaccgaggugcuguggaccagcaacuccauuguuguguucuguggcacaucugggaccuacggaacaggcagcuggccugauggggcugacaucaaucugaugcccaucuga

SEQ ID NO: 199507 - RNA, 1407 nt, Artificial Sequence
  derived and/or modified sequence opt5 from neuraminidase__InfluenzaA__ACG80446
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagaugaugcuuugugaacccacaauuaucgagagaaauauuaccgaaaucguuuaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugugucuugcgauccugacaaguguuaccaauucgcucuugggcagggaaccacacugaauaacguccauagcgauaccgcccgggaccgcacgccguauagaacacuccugaugaaugaacugggcgugcccuuucaccucgggaccaagcagguuugcauugccugguccucuagcuccugucaugauggaaaggcuuggcugcacgugugcaucacaggcgacgauaaaaacgccaccgcuagcuucauuuacaauggccggcuugucgacucugugguuuccuggagcaaagagauccugcgcacccaggaaucugagugugugugcauuaacgggacauguacggucgugaugaccgauggauccgccagcggcgaggcggacacaaagauccucuuuaucgaagaggggaaaauugugcauaccuccacacugucuggaagcgcccaacacgucgaagagugcuccugcuauccuagauaccccggcguucggugugugugccgcgauaauuggaaggggagcaacagaccuaucguggacauuaacaucaaggaccacucuauugucuccagcuacguguguucuggacuuguuggcgauacgccccggaaaaaugacagcuccucuagcucccauugccuggauccgaacaaugaagagggcgggcacggagugaagggcugggcuuucgacgaugggaacgacgucuggaugggacgcaccaucagcgagaaaucuagacucggcuaugaaacauuuaaggugaucgaggggugguccaauccuaaaagcaagcugcagauuaaccggcagguuaucguggaucgcggaaauagaucuggcuacuccggcauuuucagcgucgaagggaaauccuguaucaaccggugcuuuuauguggagcugauuagaggacgcaaggaagagaccgagguccucuggaccucuaauagcaucgugguuuucuguggcacauccgggaccuacggaacaggcucuuggcccgacggggccgauauuaaccugaugccuaucuga

SEQ ID NO: 199508 - RNA, 1410 nt, Artificial Sequence
  derived and/or modified sequence opt5 from neuraminidase__InfluenzaA__ACG80455
augaaccccaaucagaagaucauuaccaucggcagcguguccuucauuaucucuagcauuugcuuuuucaugcaaaucgccauccugauuacaacggucacccuccacuuuaaacaguacgaguucaacuccccuccgaauaaccagaugaugcugugugaacccacaaucauugagagaaauaucaccgaaauuguuuaucuuacaaacaccacaaucgagaaggaaauuugcccuaaacuggcugaguaccggaauuggucuaagccccagugugacaucaccggguuugccccuuucagcaaagauaacuccauccgccucucugcgggaggcgacauuugggugacgagagagcccuaugugagcugcgauccugacaaguguuaccaauuugcucuggggcagggaaccacacuuaauaacguccauuccaaugauaccgcccggggccgcacaccguauagaacccugcucaugaacgaacugggggugcccuuccaccugggaacgaagcagguuugcaucgccuggucuagcuccagcugucaugacggcaaggcuuggcuccacgugugcauuacaggcgaugacaaaaaugccaccgcuucuuuuaucuacgaugggcggcuggucgacuccgugguuagcuggucuaaagagauucuucgcacacaggaauccgagugugugugcaucaacggaaccuguaccgucgugaugacagauggcagcgccuccggggaggcggacacgaagauccuguucauugaagagggaaaaaucgugcauaccucuacacucagcggcuccgcccaacacgucgaagagugcagcugcuauccuagauaccccgggguucggugugugugccgcgauaauuggaagggaucuaacagaccuauuguggacaucaacauuaaggaccacuccaucgucagcucuuacguguguagcggccugguuggcgauacaccccggaaaaaugacuccucuagcuccagccauugccuugauccgaacaaugaagaagggggacacggcgugaaggggugggcuuuugacgauggaaacgacgucuggaugggccgcaccaucucugagaaauccagacugggguaugagaccuucaaggugauugagggauggagcaauccuaaaucuaagcuccagaucaaccggcagguuauuguggaucgcggcaauagauccggcuacagcgggaucuuuuccgucgaaggaaaaucuuguauuaaccggugcuucuauguggagcugaucagaggccgcaaggaagagacggagguccuguggacaagcaauuccauugugguuuucugugggaccucuggaaccuacggcacagggagcuggcccgacggcgccgauaucaaccucaugccuaucuga

SEQ ID NO: 199509 - RNA, 1407 nt, Artificial Sequence; identical to SEQ ID NO: 199507
  derived and/or modified sequence opt5 from neuraminidase__InfluenzaA__ACG80464

SEQ ID NO: 199510 - RNA, 1410 nt, Artificial Sequence
  derived and/or modified sequence opt5 from neuraminidase__InfluenzaA__ACG80473
auggaccccauccagaagauuaucaccauuggcagcgugucccugacaaucucuacgauuugcuucuuuaugcaaaucgccauccucauuaccacagucacccugcacuucaaacaguacgaguuuaacagcccuccgaauaaccagaugaugcuuugugaacccacaaucauugagagaaauaucaccgaaauuguuuaucugacaaacaccacgaucgagaaggaaauuugcccuaaacucgcugaguaccggaauugguccaagccccagugugauaucaccggguucgccccuuuuucuaaagacaacagcauccgccuguccgcgggaggcgauauuugggugacaagagagcccuaugugucuugcgacccugauaaguguuaccaauucgcucuugggcagggaaccacacugaauaacguccauagcaaugacaccgcccggggccgcacgccguauagaacacuccugaugaacgaacugggggugcccuuucaccucggaaccaagcagguuugcaucgccugguccucuagcuccugucaugauggcaaggcuuggcugcacgugugcauuacaggcgacgauaaaaaugccaccgcuagcuucaucuacgacgggcggcuugucgauucugugguuuccuggagcaaagagauucugcgcacccaggaaucugagugugugugcaucaacggaacauguacggucgugaugaccgacggcuccgccagcggggaggcggauacaaagauccucuuuauugaagagggaaaaaucgugcauaccuccacacugucuggcagcgcccaacacgucgaagagugcuccugcuauccuagauaccccgggguucggugugugugccgcgacaauuggaagggaagcaacagaccuauuguggacaucaauauuaaggaucacucuaucgucuccagcuacguguguucuggccuuguuggcgacacgccccggaaaaacgauagcuccucuagcucccauugccuggacccgaacaaugaagaagggggacacggcgugaaggggugggcuuucgaugacggaaacgaugucuggaugggccgcaccaucagcgagaaaucuagacucggguaugagacauuuaaggugauugagggaugguccaauccuaaaagcaagcugcagaucaaccggcagguuauuguggaccgcggcaauagaucuggcuacuccgggaucuucagcgucgaaggaaaauccuguauuaaccggugcuuuuauguggagcugaucagaggccgcaaggaagagaccgagguccucuggaccucuaauagcauugugguuuucugugggacauccggaaccuacggcacagggucuuggcccgauggcgccgacaucaaccugaugccuaucuga

SEQ ID NO: 199511 - RNA, 1410 nt, Artificial Sequence; identical to SEQ ID NO: 197736
  derived and/or modified sequence opt5 from neuraminidase__InfluenzaA__ACH69559

SEQ ID NO: 199512 - RNA, 1410 nt, Artificial Sequence
  derived and/or modified sequence opt5 from neuraminidase__InfluenzaA__ACH69570
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaauaacgauagcuccucuagcucccauugccuggacccgaauaacgaggaaggcgggcacggagugaagggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggaaaucgcucuggcuauuccggcauuuucagcgucgaggggaaguccuguaucaacagaugcuuuuacguggaacugauucggggaagaaaagaggaaaccgagguucucuggaccucuaauagcaucguggucuucuguggcacauccgggaccuauggaacaggcucuuggcccgauggggcugacauuaaccugaugccuaucuga

SEQ ID NO: 199513 - RNA, 1410 nt, Artificial Sequence; identical to SEQ ID NO: 197736
  derived and/or modified sequence opt5 from neuraminidase__InfluenzaA__ACH69581

SEQ ID NO: 199514 - RNA, 1410 nt, Artificial Sequence
  derived and/or modified sequence opt5 from neuraminidase__InfluenzaA__ACH69592
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaggcuuggcuucauguguguguuacaggcgaugacgagaacgccaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaaaagccgcucuggauacgagacguuuaaagugauugaaggcugguccaagcccaauagcaaacugcagaucaacagacaggucaucguggaccggggcaaucgcucuggguauuccggaauuuucagcgucgagggcaaguccugcaucaaccaguguuuuuacguggaacugauuagagggcggaagcaagagacagaaguucucuggaccucuaauagcaucguggucuucugcggaaccuccggcacauaugggaccggcucuuggccugauggagccgaccugaaccuuaugcccauuuga

SEQ ID NO: 199515 - RNA, 1410 nt, Artificial Sequence
  derived and/or modified sequence opt5 from neuraminidase__InfluenzaA__ACH69603
augaaccccaaucagaagaucauuaccaucggcagcgugucccugacaauugccacgaucugcuuccucaugcaaauugucauccugguuaccacagugacccuucacuuuaaacaguacgaguguaacucuccuccgaauaaccaggugaugcugugcgaacccacaaucauugagagaaauaucaccgaaauugucuaucucacaaacaccacgaucgagaaggaaauuuguccuaaacuggcugaguaccggaauuggagcaagccccagugcaacaucaccggguucgccccuuuuuccaaagacaauucuauucgccuuagcgcgggaggcgauaucugggugacaagagagcccuauguuuccugugacccugauaagugcuaccaauucgcucuggggcagggaaccacacucaacaauggccauucuaacgacaccgugcacgaucggacgccguaucgcacacugcugaugaaugaacucgggguccccuuucaucugggaaccaaacagguguguaucgccuggagcuccagcucuugccacgacggcaaggccuggcuucauguuugugugacaggcgaugacgagaacgcuaccgccuccuucauuuacaaugggagacuggucgauagcaucggaucuugguccaagaaaauucuccggacccaggaaagcgagugcguguguaucaacggcacaugcacgguggucaugaccgacgggucugcuuccggaaaggccgauacaaaaauucuguuuaucgaggaaggcaagaucguucacaccagcccucuuuccgggucugcgcaacacguggaggaaugcagcuguuauccccgcuacccuggagugagaugcgucugucgggacaacuggaagggcuccaaucgccccauuguggauaucaacguuaaagacuacagcauugugucuuccuaugucugcagcggccuggugggggacacaccgagaaagaaugauucuagcuccucuagccauugucucgacccuaacaaugaggaaggaggccacgggguuaaaggaugggccuucgaugacggcaacgauguguggauggggcggaccaucuccgaaaagagccgcucuggauacgagacguuuaaagucauugagggcugguccaagcccaauagcaaacugcagaucaacagacaggugaucgucgaccggggcaaucgcucuggguauuccggaauuuucagcguggagggcaaguccugcaucaacagauguuuuuacguugaacugauucgggggagaaagcaggagacagaagugcucuggaccucuaauagcaucgucguguucugcggaaccuccggcacauaugggaccggcucuuggccugauggagcugaccugaaccuuaugcccauuuga

SEQ ID NO: 199516 - RNA, 1410 nt, Artificial Sequence
  derived and/or modified sequence opt5 from neuraminidase__InfluenzaA__ACH69614
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaggcuuggcuucauguguguguuacaggcgaugacgagaacgccaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaaaagccgcucuggauacgagacguuuaaagugauugaaggcugguccaagcccaauagcaaacugcagaucaacagacaggucaucguggaccggggcaaucgcucuggguauuccggaauuuucagcgucgagggcaaguccugcaucaacagauguuuuuacguggaacugauucgggggagaaagcaggagacagaaguucucuggaccucuaauagcaucguggucuucugcggaaccuccggcacauaugggaccggcucuuggccugauggagccgaccugaaccuuaugcccauuuga

SEQ ID NO: 199517 - RNA, 1413 nt, Artificial Sequence
  derived and/or modified sequence opt5 from neuraminidase__InfluenzaA__ACI22525
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaacaauaccuaugucaacaucaauaacacaaauguuguggccgaaaaagacaagaccucugugacacuggcgggaaacagcucccuuuguagcauuucuggcugggcuaucuacaccaaagauaauuccauucggaucgggagcaagggagacgucuucgugauucgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccaaguucgaaucuguggccuggagcgcuuccgccugucacgauggaaugggcuggcugaccaucgggauuagcggaccugacaacggcgcggucgccgugcugaaauauaaugggaucauuacagagaccaucaagucuuggaaaaagcggauucucagaacgcaggaguccgaaugcguuuguaugaacggaagcugcuuuacaaucaugaccgauggccccucuaauggcgcugccagcuacaaaaucuucaagauugagaaggggaaagugacaaaguccaucgaacugaacgcuccuaauuuucauuaugaggaguguucuugcuacccggacaccggaaccgucaugugugugugccgcgauaacuggcacggcagcaauagacccuggguguccuucaaccagaaucuugacuaccagauuggguauaucugcagcggagucuuuggcgauaacccucggcccaaagacggggaaggaucuuguaauccuguuacaguggauggcgccgacggcgugaagggguucuccuacaaauauggaaacggcgucuggauugggcgcacgaaguccaauagacugcggaaaggauuugagaugaucugggaccccaacggcuggaccaauacagauucugacuucuccgugaagcaagauguuguggcgauuaccgacuggagcggguacuccggcucuuuuguccagcacccggaacucacaggacuggauugcauccgcccuuguuucuggguggagcuuguuagaggccugccccgggaaaacaccacgaucuggacaagcggguccucuauuagcuucugcggagugaacuccgacaccgccaauuggagcuggccugauggcgcugagcuccccuuuaccaucgacaaguga

SEQ ID NO: 199518 - RNA, 1413 nt, Artificial Sequence; identical to SEQ ID NO: 199517
  derived and/or modified sequence opt5 from neuraminidase__InfluenzaA__ACI22526

SEQ ID NO: 199519 - RNA, 1413 nt, Artificial Sequence; identical to SEQ ID NO: 199517
  derived and/or modified sequence opt5 from neuraminidase__InfluenzaA__ACI22527

SEQ ID NO: 199520 - RNA, 1413 nt, Artificial Sequence; identical to SEQ ID NO: 199517
  derived and/or modified sequence opt5 from neuraminidase__InfluenzaA__ACI22528

SEQ ID NO: 199521 - RNA, 1413 nt, Artificial Sequence; identical to SEQ ID NO: 199517
  derived and/or modified sequence opt5 from neuraminidase__InfluenzaA__ACI22529

SEQ ID NO: 199522 - RNA, 1413 nt, Artificial Sequence; identical to SEQ ID NO: 199517
  derived and/or modified sequence opt5 from neuraminidase__InfluenzaA__ACI22530

SEQ ID NO: 199523 - RNA, 1413 nt, Artificial Sequence
  derived and/or modified sequence opt5 from neuraminidase__InfluenzaA__ACI22532
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaacaauaccuaugucaacaucaauaacacaaauguuguggccggaaaagacaagaccucugugacacuggcgggcaacagcucccuuuguagcauuucugggugggcuaucuacaccaaagauaauuccauucggaucggaagcaagggcgacgucuucgugauucgcgaaccuuuuaucucuugcucccaccuggaguguagaacguucuuucucacccaaggcgcccugcuuaacgauaaacauagcaaugggacaguuaaggaccggucuccguaucgcgcccugauguccugcccccucggagaagcuccuagccccuacaacuccaaguucgagucuguggccuggagcgcuuccgccugucacgauggcaugggguggcugaccaucggaauuagcggcccugacaacggggcggucgccgugcugaaauauaauggaaucauuacagaaaccaucaagucuuggaaaaagcggauucucagaacgcaggaguccgagugcguuuguaugaacggcagcugcuuuacaaucaugaccgauggccccucuaauggggcugccagcuacaaaaucuucaagauugaaaagggaaaagugacaaaguccaucgagcugaacgcuccuaauuuucauuaugaagaguguucuugcuacccggacaccggcaccgucaugugugugugccgcgauaacuggcacgggagcaauagacccuggguguccuucaaccagaaucuugacuaccagauuggauauaucugcagcggcgucuuuggggauaacccucggcccaaagacggagagggcucuuguaauccuguuacaguggauggcgccgacggggugaagggauucuccuacaaauauggcaacggggucuggauuggacgcacgaaguccaauagacugcggaaaggcuuugaaaugaucugggaccccaacggguggaccaauacagauucugacuucuccgugaagcaagauguuguggcgauuaccgacuggagcggcuacuccggaucuuuuguccagcacccggagcucacaggccuggauugcauccgcccuuguuucuggguggaacuuguuagagggcugccccgggagaacaccacgaucuggacaagcggauccucuauuagcuucugcggcgugaacuccgacaccgccaauuggagcuggccugauggggcugaacuccccuuuaccaucgacaaguga

SEQ ID NO: 199524 - RNA, 1413 nt, Artificial Sequence; identical to SEQ ID NO: 199523
  derived and/or modified sequence opt5 from neuraminidase__InfluenzaA__ACI22533

SEQ ID NO: 199525 - RNA, 1413 nt, Artificial Sequence; identical to SEQ ID NO: 199517
  derived and/or modified sequence opt5 from neuraminidase__InfluenzaA__ACI22534

SEQ ID NO: 199526 - RNA, 1410 nt, Artificial Sequence
  derived and/or modified sequence opt5 from neuraminidase__InfluenzaA__ACI25727
augaaccccaaucagaagaucauuaccaucggcagcgugucccugacaauugccacggucugcuuccucaugcaaaucgcuauucugguuaccacagugacccuucacuuuaaacagcaugaguguaacucuccugccagcaaucaggugaugccgugcgaacccaucaucauugagagaaacaucacagaaauugucuaccugaauaacaccacaaucgagaaggaaauuuguccuaaagugguugaguaucggaauugguccaagccccagugccaaaucaccggguucgcgccuuuuucuaaagacaacagcauucgccucuccgcuggaggcgauaucugggugacgagagagcccuacgucucuugugacccugggaagugcuaucaguucgcccugggacagggcaccacacuugauaauaagcacagcaacgacaccauccaugaucggauuccgcaccgcacacugcucaugaaugaacugggggugcccuuucaucugggaaccagacagguuuguaucgccugguccucuagcuccugccacgacggcaaggcuuggcuccacguguguauuacgggcgaugacaaaaacgccacagcuagcuucaucuacgaugggcggcuggucgacucuauuggauccuggagccaaaauauccuucgcacccaggagucugaaugcguguguaucaacggcacaugcaccguggucaugaccgauggguccgccagcggcagagcggacacacggauucuguuuaucaaagagggaaagauuguucauaucuccccucucucugggagcgcccagcacguggaggaaugcuccuguuauccccgcuacccuggagugagaugcauuugucgggauaauuggaaaggcagcaaccgccccgucguggacaucaacauggaggacuauucuaucgauuccagcuacguuugcucuggccuggugggggacacgccgagaaaugaugaccggagcuccaacucuaauugucgcaacccuaauaacgaaagaggaaaucagggcgucaaggggugggcuuucgauaacggagacgauguguggaugggccggaccauuagcaaggaccuuagauccggguacgagacauuuaaaguuaucggaggcuggagcacccccaauucuaagucccaaauuaaccgccaggugaucgucgauagcgacaaucggucuggcuauuccgggauuuucagcguggaaggaaaauccugcaucaacagauguuuuuacgucgagcugauucgcggccggaagcaggagacaagagugugguggaccucuaauagcaucguuguguucugcgggacguccggaacauauggcaccgggucuuggccugauggcgccaacaucaauuuuaugcccauuuga

SEQ ID NO: 199527 - RNA, 1410 nt, Artificial Sequence
  derived and/or modified sequence opt5 from neuraminidase__InfluenzaA__ACI25749
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccauuagcaaggaucuuagauccggguaugaaacauuuaagguuaucggaggcuggagcaccccuaacucuaaaucccaaauuaaucgccaggugaucgucgacagcgauaaccggucuggcuacuccgggauuuucagcguggagggaaaguccugcaucaauagauguuuuuaugucgagcugauucgcggccggaaacaggaaacaagagugugguggaccucuaacagcaucguuguguucugcgggacguccggaacauacggcaccgggucuuggcccgacggcgccaauaucaacuuuaugcauauuuga

SEQ ID NO: 199528 - RNA, 1410 nt, Artificial Sequence; identical to SEQ ID NO: 199527
  derived and/or modified sequence opt5 from neuraminidase__InfluenzaA__ACI25760

SEQ ID NO: 199529 - RNA, 1410 nt, Artificial Sequence; identical to SEQ ID NO: 199527
  derived and/or modified sequence opt5 from neuraminidase__InfluenzaA__ACI25771

SEQ ID NO: 199530 - RNA, 1410 nt, Artificial Sequence; identical to SEQ ID NO: 197119
  derived and/or modified sequence opt5 from neuraminidase__InfluenzaA__ACI25782

SEQ ID NO: 199531 - RNA, 1410 nt, Artificial Sequence
  derived and/or modified sequence opt5 from neuraminidase__InfluenzaA__ACI25793
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgugggaggcgacaucugggucacgagagagcccuaugugucuugugaucaugggaagugcuaccaguucgcucugggacagggcaccacacuugacaacaagcacagcaaugauaccauccaugaccggauuccucaccgcacacugcucaugaacgaacuggggguuccguuucaucugggaaccagacagguguguaucgccugguccuccucuuccugccacgauggcaaagccuggcuccacgucuguauuacgggcgacgauaagaaugcuacagccagcuucaucuaugacgggcggcugguggauucuauuggauccuggagccaaaacauccuucgcacccaggagucugaaugcguguguaucaauggcacaugcaccgucguuaugaccgacggguccgcuagcggcagagccgauacacggauucuguuuaucgaggagggaaaaauugugcauaucagcccccucucugggagcgcgcagcacguggaagagugcuccuguuacccucgcuaucccggagucagaugcauuugucgggacaacuggaagggcagcaaucgcccugugguugacaucaacauggaagauuacucuaucgacuccagcuacgugugcucuggccuggucggggauacgcccagaaacgacgaucggagcuccaauucuaacugucgcaauccgaacaaugagagaggaaaccagggcgugaaagggugggccuucgacaauggagaugacguuuggaugggccggaccauuagcaaggaucuuagauccggguaugaaacauuuaaggugaucggaggcuggagcaccccuaacucuaaaucccaaauuaaucgccaggucaucguggacagcgauaaccggucuggcuacuccgggauuuucagcgucgagggaaaguccugcaucaauagauguuuuuauguggagcugauucgcggccggaaacaggaaacaagaguuugguggaccucuaacagcaucguggucuucugcgggacguccggaacauacggcaccgggucuuggcccgacggcgcuaauaucaacuuuaugccuauuuga

SEQ ID NO: 199532 - RNA, 1410 nt, Artificial Sequence
  derived and/or modified sequence opt5 from neuraminidase__InfluenzaA__ACI25804
augaaccccaaucagaagaucauuaccaucggcagcgugucccugacaauugccacggucugcuuccucaugcaaaucgcuauucugguuaccacagugacccuucacuuuaaacaguacgagugugacucuccugccagcaaccaggugaugccgugcgaacccaucaucauugagagaaauaucacagaaauugucuaucugaacaauaccacaaucgagaaggaaauuuguccuaaagugguugaguaccggaacugguccaagccccagugccaaaucaccggguucgcgccuuuuucuaaagauaauagcauucgccucuccgcuggaggcgacaucugggugacgagagagcccuaugucucuugugaucaugggaagugcuaccaguucgcccugggacagggcaccacacuugacaacaagcacagcaaugauaccauccaugaccggauuccucaccgcacacugcucaugaacgaacugggggugccguuucaucugggaaccagacagguuuguaucgccugguccuccucuuccugccacgauggcaaggcuuggcuccacguguguauuacgggcgacgauaaaaaugccacagcuagcuucaucuaugacgggcggcuggucgauucuauuggauccuggagccaaaacauccuucgcacccaggagucugaaugcguguguaucaauggcacaugcaccguggucaugaccgacggguccgccagcggcagagcggauacacggauucuguuuaucgaggagggaaaaauuguucauaucagcccccucucugggagcgcccagcacguggaagagugcuccuguuacccucgcuaucccggagugagaugcauuugucgggacaacuggaagggcagcaaucgcccugucguggacaucaacauggaagauuacucuaucgacuccagcuacguuugcucuggccuggugggggauacgcccagaaacgacgaucggagcuccaauucuaacugucgcaauccgaacaaugagagaggaaaccagggcgucaaagggugggcuuucgacaauggagaugacguguggaugggccggaccauuagcaaggaucuuagauccggguaugaaacauuuaagguuaucggaggcuggagcaccccuaacucuaaaucccaaauuaaucgccaggugaucgucgacagcgaucaucggucuggcuacuccgggauuuucagcguggagggaaaguccugcaucaacagauguuuuuaugucgagcugauucgcggccggaaacaggaaacaagagugugguggaccucuaauagcaucguuguguucugcgggacguccggaacauacggcaccgggucuuggcccgacggcgccaacaucaauuuuaugccuauuuga

SEQ ID NO: 199533 - RNA, 1410 nt, Artificial Sequence; identical to SEQ ID NO: 199491
  derived and/or modified sequence opt5 from neuraminidase__InfluenzaA__ACI26277

SEQ ID NO: 199534 - RNA, 1410 nt, Artificial Sequence; identical to SEQ ID NO: 197351
  derived and/or modified sequence opt5 from neuraminidase__InfluenzaA__ACI26299

SEQ ID NO: 199535 - RNA, 1410 nt, Artificial Sequence
  derived and/or modified sequence opt5 from neuraminidase__InfluenzaA__ACI26321
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaccguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggacaucuaacagcaucguuguguucuguggcaccuccgggacauacggaacgggcucuuggcccgacggggcugauauuaaucugaugccuaucuga

SEQ ID NO: 199536 - RNA, 1410 nt, Artificial Sequence
  derived and/or modified sequence opt5 from neuraminidase__InfluenzaA__ACI26354
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggcccgacggggcugauauuaaucugaugccuaucuga

SEQ ID NO: 199537 - RNA, 1410 nt, Artificial Sequence
  derived and/or modified sequence opt5 from neuraminidase__InfluenzaA__ACI26365
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccagcagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugaccggaucugcgcaacacguggaggaaugcagcugcuauccuagauaccccggcgugcggugugucugccgcgauaacuggaagggguccaacagaccuaucguggacauuaauaucaaagaccacagcauuguuucuuccuacguguguagcggacuugucggcgauacgccccggaagaacgacucuagcuccucuagccauugccuggauccgaauaacgaggaaggcgugcacgggguuaaaggaugggccuucgacgauggcaaugacguguggauggggcgcacaaucuccgagaagucuagacucggauaugagaccuuuaaagucaucgaaggcuggucuaacccuaaguccaaacugcagauuaaucgccaggugaucgucgaucgggggaacagaagcggauacucuggcauuuucuccguggagggcaagagcuguaucaaucggugcuuuuauguugaacugauuagagggcgcaaggaggaaaccgaggugcucuggacauccaacucuaucgucguguucuguggaaccagcggcacauacgggacgggauccuggcccgacggcgcugauauuaaucugaugccuaucuga

SEQ ID NO: 199538 - RNA, 1410 nt, Artificial Sequence; identical to SEQ ID NO: 199536
  derived and/or modified sequence opt5 from neuraminidase__InfluenzaA__ACI26376

SEQ ID NO: 199539 - RNA, 1410 nt, Artificial Sequence; identical to SEQ ID NO: 199428
  derived and/or modified sequence opt5 from neuraminidase__InfluenzaA__ACI26387

SEQ ID NO: 199540 - RNA, 1410 nt, Artificial Sequence; identical to SEQ ID NO: 199440
  derived and/or modified sequence opt5 from neuraminidase__InfluenzaA__ACI26420

SEQ ID NO: 199541 - RNA, 1410 nt, Artificial Sequence; identical to SEQ ID NO: 197351
  derived and/or modified sequence opt5 from neuraminidase__InfluenzaA__ACI26431

SEQ ID NO: 199542 - RNA, 1413 nt, Artificial Sequence
  derived and/or modified sequence opt5 from neuraminidase__InfluenzaA__ACI26442
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguaaaacguucuuucucacccaaggcgcccugcuuaaugauaagcacagcaacgggacaguuaaggacagaucuccguaucgggcccugauguccugcccccucggagaagcuccuagccccuacaauuccaaauucgagucuguggccuggagcgcuuccgccugucaugauggcaugggguggcugaccaucggaauuagcggcccugacaacggggcggucgccgugcugaaguauaacggaaucauuacaggcaccaucaaaucuuggaagaaacagauucuccgcacgcaggaauccgagugcguuuguaugaauggcagcugcuuuacaaucaugaccgaugggcccucuaacggagcugccagcuacaagaucuucaagauugagaaaggcaaggugacaaaauccaucgaacugaaugcuccuaacuuucacuaugaggaauguucuugcuacccggacaccgggaccgucaugugugugugcagagauaauuggcacggaagcaaccggcccuggguguccuucaaucagaaccuugacuaccaaauuggcuauaucugcagcggggucuuuggagauaauccucgccccaaggacagagagggcucuuguaacccuguuacaauugauggcgccgacggggugaaaggauucuccuacaaguauggcaaugggguguggaucggacggacgaaaagcaaccgccugagaaagggcuuugagaugauuugggaccccaauggguggaccaacacagauucugacuucuccgucaagcaggaugugguugcgaucaccgacuggagcggcuacuccggaucuuuugugcagcauccggaacucacaggccuggauugcauccggccuuguuucugggucgagcuugugcgcgggcugcccagagaaaauaccacgauuuggacaagcggauccucuaucagcuucugcggcguuaacuccgacaccgccaacuggagcuggccugauggggcugagcuccccuuuaccauugacaaauga

SEQ ID NO: 199543 - RNA, 1413 nt, Artificial Sequence; identical to SEQ ID NO: 199542
  derived and/or modified sequence opt5 from neuraminidase__InfluenzaA__ACI26453

SEQ ID NO: 199544 - RNA, 1410 nt, Artificial Sequence
  derived and/or modified sequence opt5 from neuraminidase__InfluenzaA__ACI26464
augaaccccaaucagaagaucauuaccaucggcagcgugucccugacaauuucuacgaucugcuucuuuaugcaaauugccauccucaucgcuaccgucacacugcacuucaaacaguacgaguuuaacagcccuccgaauaaccagguuaugcuuugugaacccaccauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucgggaccgcaccccguauagaacgcuccugaugaacgaacugggcgugcccuuucaccucgggacaaagcaggucugcauugccugguccucuagcuccugucaugauggaaaggcuuggcugcacgugugcaucaccggcgacgauaaaaaugccacagcuagcuucauuuacaacggccggcuuguugacucuaucguguccuggagcaaagagauucugcgcacccaggaaucugagugugucugcaucaaugggaccuguacaguggugaugacggauggauccgccagcggcaaggcggacaccaaaauccucuuuauugaggaagggaagaucguccauacauccacccugucuggaagcgcccaacacguugaggaaugcuccugcuauccuagauaccccggcgugcggugugugugccgcgauaacuggaaggggagcaacagaccuauugucgacaucaauauuaaagaccacucuacaguguccagcuacguuuguucuggacuugugggcgauacgccccggaagaacgacagcuccucuagcucccauugccuggauccgaauaacgaggaaggcgggcacggagucaaaggcugggcuuucgacgaugggaaugacguguggaugggacgcaccaucagcgagaagucuagacucggcuaugagacauuuaaaguuaucgaagggugguccaacccuaagagcaaacugcagauuaaucgccaggugaucgucgaucggggaaacagaucuggcuacuccggcauuuucagcguggaggggaaguccuguaucaaucggugcuuuuaugucgaacugauuagaggacgcaaggaggaaaccgaggugcucuggaccucuaacagcaucguuguguucuguggcacauccgggaccuacggaacaggcucuuggcccgacggggccgauauuaaucugaugccuaucuga

SEQ ID NO: 199545 - RNA, 1410 nt, Artificial Sequence; identical to SEQ ID NO: 199535
  derived and/or modified sequence opt5 from neuraminidase__InfluenzaA__ACI26475

SEQ ID NO: 199546 - RNA, 1410 nt, Artificial Sequence; identical to SEQ ID NO: 199536
  derived and/or modified sequence opt5 from neuraminidase__InfluenzaA__ACI26486

SEQ ID NO: 199547 - RNA, 1410 nt, Artificial Sequence; identical to SEQ ID NO: 199536
  derived and/or modified sequence opt5 from neuraminidase__InfluenzaA__ACI26497

SEQ ID NO: 199548 - RNA, 1410 nt, Artificial Sequence; identical to SEQ ID NO: 199536
  derived and/or modified sequence opt5 from neuraminidase__InfluenzaA__ACI26508

SEQ ID NO: 199549 - RNA, 1410 nt, Artificial Sequence
  derived and/or modified sequence opt5 from neuraminidase__InfluenzaA__ACI26519
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggcccgacggggcuaauauuaaccugaugccuaucuga

SEQ ID NO: 199550 - RNA, 1410 nt, Artificial Sequence; identical to SEQ ID NO: 199536
  derived and/or modified sequence opt5 from neuraminidase__InfluenzaA__ACI26530

SEQ ID NO: 199551 - RNA, 1410 nt, Artificial Sequence; identical to SEQ ID NO: 199536
  derived and/or modified sequence opt5 from neuraminidase__InfluenzaA__ACI26541

SEQ ID NO: 199552 - RNA, 1410 nt, Artificial Sequence
  derived and/or modified sequence opt5 from neuraminidase__InfluenzaA__ACI26552
augaaccccaaucagaagaucauuaccaucggcagcgugucccugacaauugccacgaugugcuuccucaugcaaaucgcuauucuggucaccacaguuacccuucacuuuaaacaguacgaguguucuagcccuccgaacaaucaggugaugcccugcgaaccuacaaucaucgagagaaacauuaccgaaaucguguaucugacaaauaccacgauugagaaggaaaucugucccaaacucgucgaguaccggaacugguccaagccucagugcaaaauuaccggguucgcccccuuuucuaaggacaauagcauccgccuguccgcgggaggcgauauuugggugacaagagagccuuauguuucuugugacccggggaagugcuaccaauucgcucuuggacagggcaccacacugaacaaucggcauagcaacgauaccgugcacgaccgcacgcccuauagaacacuccugaugaaugaacugggggucccuuuucaucucggaaccaaacagguguguaucgccugguccuccucuuccugccacgauggcaaggccuggcugcauguuugugugacaggccacgacaaaaacgcuaccgccagcuucaucuacgaugggcggcuugucgacucuauuggauccuggagcaagaauauccugcgcacccaggagucugaaugcguguguauuaacggcacaugcacgguggucaugaccgauggguccgcuagcgagagagccgacacaaaaauccucuuuauugaggaaggaaagaucguucacaucagcccccugucuggcagcgcgcaacauguggaggaaugcuccuguuauccucgguaccccggggugcgcugcgucuguagagauaauuggaagggaagcaaccggccgauuguggacaucaacguuaaagauuacucuauuguguccagcuaugucugcucuggccuugugggcgacaccccucgcaagaaugacagaagcuccucuagcuacugucggaaccccaauaacgagaaagggucccacggaguuaagggcugggccuucgaugacgggaaugauguguggaugggacgcacaaucagcgaggaacugagaucuggcuaugagaccuuuaaagucauugggggaugguccacgccuaacagcaagcuccagaucaauagacaggugaucgucgacucuggcaaccgguccggcuacagcgggauuuucuccguggaaggaaaaucuugcaucaaucgcuguuuuuauguugagcugauucggggcagagaacaggagacacgcgugugguggaccagcaacuccaucgucguguucugcgggaccucuggaacauacggcaccgggagcuggcccgauggcgcugacauuaaucugaugcccaucuga

SEQ ID NO: 199553 - RNA, 1410 nt, Artificial Sequence
  derived and/or modified sequence opt5 from neuraminidase__InfluenzaA__ACI26574
augaaccccaaucagaagaucauuaccaucggcagcgugucccugacacucgccacgauuugcuuccugaugcaaaucgcuauucuugucaccacaguuacccugcacuuuaaacaguacgaguguucuagcccuccgaacaaucaggugaugcccugcgaaccuacaaucaucgagagaaacauuaccgaaaucguguaucucacaaauauuaccaucgagaaggaaauuugucccaaacuggucgaguaccggaacugguccaagccucagugcaaaaucacgggguucgcccccuuuucuaaggacaauagcauucgccuuuccgcgggaggcgauaucugggugaccagagagccuuauguuucuugugacccgagcaagugcuaccaauucgcucuggggcagggaacaacccucaacaaucggcauuccaacgauacagugcacgaccgcacccccuauagaacgcugcugaugaaugaacucggcgucccuuuucaucuggggacacgccagguguguauggccuggucuagcuccagcugccacgauggaaaagccuggcuucauguuugugugaccggccacgacgagaacgcuacagccucuuucaucuacgauggccggcuggucgacuccauugggagcuggucuaagaauauccucagaacccaggaauccgagugcguguguauuaacggaaccugcacaguggucaugacggauggcagcgcuuccgagcgggccgacaccaaaauccuguuuauugaagaggggaagaucguucacaucucuccccuuagcggauccgcgcaacauguggaagagugcagcuguuauccucgcuaccccggcgugagaugcgucugucgggauaauuggaaagggucuaaccgcccgauuguggacaucaacguuaaggauuacuccauugugagcucuuaugucugcagcggacuggugggcgacacaccuagaaagaaugaccgguccucuagcuccuacugucgcaaccccaauaacgaaaaaggcagccacgggguuaagggaugggccuucgaugacggcaaugauguguggauggggagaaccaucggagaggagcuccggucuggcuaugaaacauuuaaagucauugggggaugguccaccccuaacagcaagcugcagaucaauagacaggugaucgucgacucuggcaaccgcuccggcuacagcgggauuuucuccguggagggaaaaucuugcaucaaucgguguuuuuauguugaacugauuagaggccgcaagcaggagacgcgggugugguggacaagcaacuccaucgucguguucugcgggaccucuggaaccuacggcacagggagcuggcccgauggcgcugacauuaaucucaugcccaucuga

SEQ ID NO: 199554 - RNA, 1410 nt, Artificial Sequence
  derived and/or modified sequence opt5 from neuraminidase__InfluenzaA__ACI26585
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcccugcgaaccuacaaucauugagagaaauaucaccgaaauuguguaccugacaaacaccacgaucgagaaggaaauuugucccaaacucgucgaguaucggaauuggagcaagccucagugcaaaaucaccggguucgcccccuuuuccaaggacaacucuauucgccugagcgcgggaggcgauaucugggugacaagagagccuuacguuuccugugacccggggaagugcuaucaauucgcucuuggacagggcaccacacugaauaaccggcacucuaaugauaccgugcaugaccgcacgcccuacagaacacuccugaugaacgaacugggggucccuuuucaccucggaaccaaacagguguguaucgccuggagcuccagcucuugccaugauggcaaggccuggcugcacguuugugugacaggccacgacgagaaugcuaccgccuccuucauuuaugaugggcggcuugucgacagcaucgugucuugguccaaaaacgugcugcgcacccaggaaagcgagugcgucuguauuaauggaacaugcacgguugugaugaccgauggcucugcuuccgagagagccgacacaaagauccucuuuauugaagaggggaaaaucgugcauaucagcccccuguccggaucugcgcaacacgucgaagagugcagcuguuacccucgguaucccggcgugcgcugcguuuguagagauaacuggaagggguccaaccggccgauuguggacaucaaugucaaggauuacagcauugugucuuccuacguuugcagcggacuugugggcgacaccccucgcaaaaacgacucuagcuccucuagcuauuguagaaaucccaacaaugaaaagggcucccauggggucaaaggaugggccuucgaugacggcaacgauguguggauggggcggacaaucggagaggagcugcgcagcggcuacgaaaccuuuaaggucauugggggauggucuacgccuaauuccaaacuccagacaaacagacaggugaucguugaccggggcaauagaagcggcuauucugggaucuucuccguggagggaaagagcugcauuaaccgcuguuuuuacgucgaacugauccggggcagaaaacaggagaccaaggugugguggaccuccaauucuauuguuguguucugcgggacaagcggaaccuauggcacaggguccuggcccgauggcgcugacaucaaccugaugcccauuuga

SEQ ID NO: 199555 - RNA, 1413 nt, Artificial Sequence
  derived and/or modified sequence opt5 from neuraminidase__InfluenzaA__ACI32764
augaaccccaaucagaagaucauuaccaucggcagcauuuccauggccaucgggauuaucucucugaugcuccaaaucggaaacauuaucagcauuugggcuucccacucuauccagacaggcagccagaaucauacggggauuugcaaccagagaaucauuaccuacgaaaauuccacaugggugaaccacaccuaugucaauaucaacaauacaaacguuguggccggaaaagacaagaccucugugacacuggcgggcaauagcucccuuuguagcaucucugggugggcuauuuacaccaaagauaacuccauccggauuggaagcaagggcgacgucuucgugauccgcgagccuuuuauuucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaaucagcggcccugacaacggggcggucgccgugcugaaauauaacggaauuaucacagaaaccauuaagucuuggaaaaagagaauccuccggacgcaggaguccgagugcguuugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugacaguggauggcgccgacggggucaaaggauucuccuacaaguauggcaaugggguguggaucggacgcacgaaaagcaacagacugcggaagggcuuugagaugauuugggaccccaauggguggaccgauacagacucugauuucuccguuaagcaagacguggucgcgaucaccgauuggagcggcuacuccggaucuuuugugcagcauccggaacucacaggccuggacugcauucgcccuuguuucuggguugagcuugugagagggcugccccgggaaaacaccacgaucuggacaagcggauccucuaucagcuucugcggcgucgauuccgacaccgccaauuggagcuggccugauggggcugagcuccccuuuaccauugacaaauga

SEQ ID NO: 199556 - RNA, 1413 nt, Artificial Sequence
  derived and/or modified sequence opt5 from neuraminidase__InfluenzaA__ACI32765
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauaacacaugggugaaucacaccuaugucaacaucaauaacacaaauguuguggcccggaaagacaagaccuccgugacacuggcgggaaacucuagccuuuguuccauuagcggcugggcuaucuacaccaaagauaauucuauucgcaucggguccaagggagacgucuucgugauuagagaaccuuuuaucagcugcucucaucuggagugucggacguucuuuaugacccaaggcgcccuccugaacgauaaacacuccaauggcacaguuaaggaccgcagcccguauagagcccuuaugucuugcccccugggggaagcuccuucccccuacaacagcaaguucgaguccguggccuggucugcuagcgccugucaugauggaaugggcuggcucaccaucgggauuuccggaccugacaacggcgcggucgccgugcugaaauauaaugggaucauuacagaaaccaucaagagcuggaaaaagcggauucugcgcacgcaggagucugagugcguuugugugaacggauccugcuuuacaaucaugaccgauggccccagcaauggcgcugccucuuacaaaaucuucaagauugaaaaggggaaagucacaaagagcguggagcucaacgcuccuaauuuucacuaugaagaguguuccugcuacccggacaccggaaccgugaugugugucugcagagauaacuggcacggcucuaaucggcccuggguuagcuucaaccagaaucuggacuaccagaucggguauauuugcuccggaguguuuggcgauaacccucgccccaaagacgggaagggaagcuguaauccugugacagucgauggcgccgacggcgugaaaggguucucuuacaaguauggaaacggcguuuggaucgggagaacgaaauccaaucggcuucgcaagggauuugagaugauuugggaccccaacggcuggaccgauacagacagcgauuucucugugaagcaagacgucguggcgaucaccgauugguccggguacagcggcuccuuuguucagcauccggaacugacaggacucgacugcauuagaccuuguuucuggguggagcugguccggggccuuccccgcgaaaauaccacgaucuggacaucugggagcuccaucucuuucugcggaguggauagcgacaccgccaacugguccuggccugauggcgcugagcugcccuuuaccauugacaaauga

SEQ ID NO: 199557 - RNA, 1413 nt, Artificial Sequence; identical to SEQ ID NO: 197410
  derived and/or modified sequence opt5 from neuraminidase__InfluenzaA__ACI32766

SEQ ID NO: 199558 - RNA, 1413 nt, Artificial Sequence
  derived and/or modified sequence opt5 from neuraminidase__InfluenzaA__ACI32767
augaaccccaaucagaagaucauuaccaucggcagcauuuccaucgccauugggaucaucucucugaugcuccaaauuggaaacaucauuagcaucugggcuucccacucuacacagacgggcagccagaaucauaccgggauuugcaaccagagaaucauuacauacgaaaauuccaccugggugaaccacacauaugucaauaucaacaauaccaacguuguggccggaaaagacaagacaucugugacccuggcgggcaauagcucccuuuguagcaucucugggugggcuauuuacacgaaagauaacuccguccggaucggaagcaagggcgacguguucguuauucgcgagccuuuuaucucuugcucccaucuggaguguagaaccuucuuucucacacaaggcgcccugcuuaaugauaaacacagcaacgggaccgugaaggaccggucuccguaucgcgcccugauguccugcccccucggagaagcuccuagccccuacaauuccaaguucgagucugucgccuggagcgcuuccgccugucaugauggcaugggguggcugacaauuggaaucagcggcccugacaacggggcgguggccguucugaaauauaacggaaucauuaccgaaacgaucaagucuuggaaaaagcggauucucagaacacaggaguccgagugcgugugugucaauggcagcugcuuuaccaucaugacagauggccccucuaacggggcugccagcuacaaaauuuucaagaucgaaaagggaaaagugaccaaguccaucgagcugaaugcuccuaacuuucacuaugaagaguguucuugcuacccggacaccggcacagugaugugugucugccgcgauaauuggcacgggagcaacagacccuggguuuccuucaaucagaaccuugacuaccagauuggauauaucugcagcggcguguuuggggauaauccucggcccaaagacggaaagggcucuuguaacccugugacggucgauggcgccgacggggugaaaggauucuccuacaaguauggcaaugggguuuggauuggacgcaccaaaagcaacagacugcggaagggcuuugagaugaucugggaccccaauggguggacagauaccgacucugauuucuccgugaagcaagacgucguggcgauuacagauuggagcggcuacuccggaucuuuuguucagcauccggaacucaccggccuggacugcauccgcccuuguuucuggguggagcuugucagagggcugccccgggaaaacacgacaauuuggaccagcggauccucuaucagcuucugcggcguggauuccgacaccgccaauuggagcuggccugauggggcugagcuccccuuuacaaucgacaaauga

SEQ ID NO: 199559 - RNA, 1413 nt, Artificial Sequence
  derived and/or modified sequence opt5 from neuraminidase__InfluenzaA__ACI32768
augaaccccaaucagaagaucauuaccaucggcagcauuuccaucgccauugggaucaucucucugaugagccaaauuggaaacaucauuuccaucugggcuucucacagcauucagacaggcucccagaaucauacggggaucugcaaccagagaauuaucaccuacgagaauagcacaugggugaaccacaccuaugucaauaucaacaauacaaacguuguggccggaaaagacaagaccagcgugacacucgcgggcaauuccagccuguguucuauuuccgggugggcuaucuacaccaaagauaacagcauucggaucggaucuaagggcgacgucuucgugauucgcgaaccuuuuaucuccugcagccaucuugaguguagaacguucuuucugacccaaggcgcccuccugaaugauaaacacucuaacgggacaguuaaggaccgguccccguaucgcgcccuuaugagcugcccccugggagaagcuccuucccccuacaauucuaaguucgagagcguggccugguccgcuagcgccugucaugauggcaugggguggcucaccaucggaauuucuggcccugacaacggggcggucgccgugcugaaauauaacggaaucauuacagaaaccaucaaguccuggaaaaagcggauucugagaacgcaggagagcgagugcguuugugugaauggcucuugcuuuacaaucaugaccgauggccccagcaacggggcugccuccuacaaaaucuucaagauugaaaagggaaaagucacaaagucuaucgagcucaaugcuccuaacuuucacuaugaagaguguagcugcuacccggacaccggcaccgugaugugugugugccgcgauaauuggcacggguccaacagacccugggucagcuucaaucagaaccuggacuaccagauuggauauaucugcucuggcguuuuuggggauaauccucggcccaaagacggaaagggcuccuguaacccugugacaguggauggcgccgacggggucaaaggauucagcuacaaguauggcaaugggguguggauuggacgcacgaaaucuaacagacuucggaagggcuuugagaugaucugggaccccaauggguggaccgauacagacuccgauuucagcguuaagcaagacguggucgcgauuaccgauugguccggcuacucuggaucuuuugugcagcauccggaacugacaggccucgacugcauccgcccuuguuucuggguugagcuggugagagggcuuccccgggaaaacaccacgaucuggacauccggaucuagcauuuccuucugcggcgucgauagcgacaccgccaauuggucuuggccugauggggcugagcugcccuuuaccaucgacaaauga

SEQ ID NO: 199560 - RNA, 1413 nt, Artificial Sequence
  derived and/or modified sequence opt5 from neuraminidase__InfluenzaA__ACI32769
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagauuucugugacccuggcgggcaauagcucccuuuguagcaucucugggugggcuauuuacacaaaagauaacuccauccggauuggaagcaagggcgacgucuucgugauccgcgagccuuuuaucucuugcucccaucuggaguguagaaccuucuuucucacgcaaggcgcccugcuuaaugauaaacacagcaacgggaccguuaaggaccggucuccguaucgcgcccugauguccugcccccucggagaagcuccuagccccuacaauuccaaguucgagucuguggccuggagcgcuuccgccugucaugauggcaugggguggcugacaauuggaaucagcggcccugacaacggggcggucgccgugcugaaauauaacggaauuaucaccgaaacaauuaagucuuggaaaaagagaauccuccggacccaggaguccgagugcguuugugugaauggcagcugcuuuacgaucaugacagauggccccucuaacggggcugccagcuacaaaauuuucaagaucgaaaagggaaaagucaccaaguccauugagcugaaugcuccuaacuuucacuaugaagaguguucuugcuacccggacacaggcaccgugaugugugugugccgcgauaauuggcacgggagcaacagacccugggucuccuucaaucagaaccuugacuaccagaucggauauauuugcagcggcguuuuuggggauaauccucggcccaaagacggaaagggcucuuguaacccugugaccguggauggcgccgacggggucaaaggauucuccuacaaguauggcaaugggguguggaucggacgcacaaaaagcaacagacugcggaagggcuuugagaugauuugggaccccaauggguggacggauaccgacucugauuucuccguuaagcaagacguggucgcgaucacagauuggagcggcuacuccggaucuuuugugcagcauccggaacucaccggccuggacugcauccgcccuuguuucuggguugagcuugugagagggcugccccgggaaaacacaaccauuuggacgagcggauccucuaucagcuucugcggcgucgauuccgacacagccaauuggagcuggccugauggggcugagcuccccuuuaccauugacaaauga

SEQ ID NO: 199561 - RNA, 1413 nt, Artificial Sequence; identical to SEQ ID NO: 197410
  derived and/or modified sequence opt5 from neuraminidase__InfluenzaA__ACI32770

SEQ ID NO: 199562 - RNA, 1413 nt, Artificial Sequence
  derived and/or modified sequence opt5 from neuraminidase__InfluenzaA__ACI32771
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacaaaaauuccacaugggugaaccacaccuaugucaauaucaacaauacaaacguuguggccggaaagggcaaaaccucugugacacuggcggggaauagcucccuuuguagcauuucuggaugggcuaucuacaccaaggacaacuccauucggaucggcagcaaaggcgaugucuucgugauucgcgagccuuuuaucucuugcucccaucuggaauguagaacguucuuucucacccaaggggcccugcuuaaugacaagcacagcaacggaacaguuaaggaucggucuccguaucgcgcccugauguccugcccccucggcgaggcuccuagccccuacaauuccaaauucgaaucuguggccuggagcgcuuccgccugucaugacgggaugggauggcugaccaucggcauuagcgggccugauaacggagcggucgccgugcugaaguauaacggcaucauuacagagaccaucaaaucuuggaagaaacggauucucagaacgcaggaauccgagugcguuugugugaauggcagcugcuuuacaaucaugaccgacgggcccucuaacggagcugccagcuacaagaucuucaagauugagaaaggcaaggucacaaaauccaucgaacugaaugcuccuaacuuucacuaugaggaauguucuugcuacccggauaccgggaccgugaugugugugugccgcgacaauuggcacggaagcaacagacccugggucuccuucaaucagaaccuugauuaccagauuggcuauaucugcagcgggguuuuuggagacaauccucggcccaaggauggcaaaggcucuuguaacccugugacaguggacggggccgauggagucaagggcuucuccuacaaauaugggaauggaguguggauuggccgcaccaagagcaacagacugcggaagggguuugagaugaucugggaccccaauggcuggacggacacagauucugacuucuccguuaaacaagauguggucgcgauuaccgacuggagcggauacuccggcucuuuugugcagcauccggagcucacagggcuggauugcauccgcccuuguuucuggguugaacuugugagaggacugccccgggagaacaccacgaucuggacaagcggcuccucuauuagcuucugcggggucgacuccgauaccgccaauuggagcuggccugacggagcugaacuccccuuuaccaucgauaaguga

SEQ ID NO: 199563 - RNA, 1413 nt, Artificial Sequence; identical to SEQ ID NO: 197410
  derived and/or modified sequence opt5 from neuraminidase__InfluenzaA__ACI32772

SEQ ID NO: 199564 - RNA, 1413 nt, Artificial Sequence; identical to SEQ ID NO: 197410
  derived and/or modified sequence opt5 from neuraminidase__InfluenzaA__ACI32773

SEQ ID NO: 199565 - RNA, 1413 nt, Artificial Sequence; identical to SEQ ID NO: 197410
  derived and/or modified sequence opt5 from neuraminidase__InfluenzaA__ACI32774

SEQ ID NO: 199566 - RNA, 1413 nt, Artificial Sequence; identical to SEQ ID NO: 197410
  derived and/or modified sequence opt5 from neuraminidase__InfluenzaA__ACI32775

SEQ ID NO: 199567 - RNA, 1413 nt, Artificial Sequence
  derived and/or modified sequence opt5 from neuraminidase__InfluenzaA__ACI32776
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacaaaaauuccacaugggugaaccacaccuaugucaauaucaacaauacaaacguuguggccggaaaggacaaaaccucugugacacuggcgggcaauagcucccuuuguagcauuucugggugggcuaucuacaccaaggauaacuccauucggaucggaagcaaaggcgacgucuucgugauucgcgagccuuuuaucucuugcucccaucuggaauguagaacguucuuucucacccaaggcgcccugcuuaaugauaagcacagcaacgggacaguuaaggaccggucuccguaucgcgcccugauguccugcccccucggagaggcuccuagccccuacaauuccaaauucgaaucuguggccuggagcgcuuccgccugucaugauggcaugggguggcugaccaucggaauuagcggcccugacaacggggcggucgccgugcugaaguauaacggaaucauuacagagaccaucaaaucuuggaagaaacggauucucagaacgcaggaauccgagugcguuugugugaauggcagcugcuuuacaaucaugaccgauggccccucuaacggggcugccagcuacaagaucuucaagauugagaaaggaaaggucacaaaauccaucgaacugaaugcuccuaacuuucacuaugaggaauguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaggacggaaaaggcucuuguaacccugugacaguggauggcgccgacggggucaagggauucuccuacaaauauggcaaugggguguggauuggacgcaccaagagcaacagacugcggaagggcuuugagaugaucugggaccccaauggguggacggauacagacucugauuucuccguuaaacaagacguggucgcgauuaccgauuggagcggcuacuccggaucuuuugugcagcauccggagcucacaggccuggacugcauccgcccuuguuucuggguugaacuugugagagggcugccccgggagaacaccacgaucuggacaagcggauccucuauuagcuucugcggcgucgauuccgacaccgccaauuggagcuggccugauggggcugaacuccccuuuaccaucgacaaguga

SEQ ID NO: 199568 - RNA, 1413 nt, Artificial Sequence
  derived and/or modified sequence opt5 from neuraminidase__InfluenzaA__ACI32777
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacaaaaauuccacaugggugaaccacaccuaugucaauaucaacaauacaaacguuguggccggaaaggacaaaaccucugugacacuggcgggcaauagcucccuuuguagcauuucugggugggcuaucuacaccaaggauaacuccauucggaucggaagcaaaggcgacgucuucgugauucgcgagccuuuuaucucuugcucccaucuggaauguagaacguucuuucucacccaaggcgcccugcuuaaugauaagcacagcaacgggacaguuaaggaccggucuccguaucgcgcccugauguccugcccccucggagaggcuccuagccccuacaauuccaaauucgaaucuguggccuggagcgcuuccgccugucaugauggcaugggguggcugaccaucggaauuagcggcccugacaacggggcggucgccgugcugaaguauaacggaaucauuacagagaccaucaaaucuuggaagaaacggauucucagaacgcaggaauccgagugcguuugugugaauggcagcugcuuuacaaucaugaccgauggccccucuaacggggcugccagcuacaagaucuucaagauugagaaaggaaaggucacaaaauccaucgaacugaaugcuccuaacuuucacuaugaggaauguucuugcuacccggacaccggcaccgugaugugugugugccgcgauaauuggcacgggagcaacagacccugggucuccuucaaucagaaccuugacuaccagauuggauauaucugcagcggcguuuuuggggauaauccucggcccaaggacggaaaaggcucuuguaacccugugacaguggauggcgccgacggggucaagggauucuccuacaaauauggcaaugggguguggauuggacgcaccaagagcaacagacugcggaagggcuuugagaugaucugggaccccaauggguggacggauacagacucugauuucuccguuaaacaagacguggucgcgauuaccgauuggagcggcuacuccggaucuuuugugcagcauccggagcucacaggccuggacugcauccgcccuuguuucuggguugaacuugugagagggcugccccgggagaacaccacgaucuggacaagcggauccucuauuagcuucugcggcgucgauuccgacaccgccaauuggagcuggccugauggggcugaacuccccuuugccaucgacaaguga

SEQ ID NO: 199569 - RNA, 1413 nt, Artificial Sequence; identical to SEQ ID NO: 197410
  derived and/or modified sequence opt5 from neuraminidase__InfluenzaA__ACI32778

SEQ ID NO: 199570 - RNA, 1413 nt, Artificial Sequence; identical to SEQ ID NO: 197410
  derived and/or modified sequence opt5 from neuraminidase__InfluenzaA__ACI32779

SEQ ID NO: 199571 - RNA, 1413 nt, Artificial Sequence; identical to SEQ ID NO: 197410
  derived and/or modified sequence opt5 from neuraminidase__InfluenzaA__ACI32780

SEQ ID NO: 199572 - RNA, 1413 nt, Artificial Sequence; identical to SEQ ID NO: 197410
  derived and/or modified sequence opt5 from neuraminidase__InfluenzaA__ACI32781

SEQ ID NO: 199573 - RNA, 1413 nt, Artificial Sequence
  derived and/or modified sequence opt5 from neuraminidase__InfluenzaA__ACI32782
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacaggcaccaucaagucuuggaaaaagcagauucucagaacgcaggaauccgagugcguuuguaugaauggcagcugcuuuacaaucaugaccgaugggcccucuaacggagcugccagcuacaaaaucuucaagauugagaagggcaaagcuacaaaguccaucgaacugaaugccccuaacuuucacuaugaggaauguucuugcuacccggacaccgggaccgugaugugugucugccgggauaauuggcacggaagcaaccgccccuggguguccuucaaucagaaccuugacuaccaaauuggcuauaucugcagcgggguguuuggagauaauccuagacccaaagaccggaagggcucuuguaacccugucacaguugauggcgcggacggggugaaaggauucuccuacaaguauggcaaugggguguggauuggacgcacgaaaagcaacagacugcggaagggcuuugagaugaucugggaccccaauggguggaccaacacagauucugacuucuccgucaagcaggaugugguugccauuaccgacuggagcggcuacuccggaucuuuugugcagcauccggagcucacaggccuggauugcauccgcccuuguuucugggucgaacuugugagagggcugccccgggagaauaccacgaucuggacaagcggauccucuauuagcuucugcggcguuaacuccgacaccgcuaacuggagcuggccugauggggccgaacuccccuuuaccaucgacaaauga

SEQ ID NO: 199574 - RNA, 1413 nt, Artificial Sequence
  derived and/or modified sequence opt5 from neuraminidase__InfluenzaA__ACI32783
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaaagcagauucucagaacgcaggaguccgagugcguuugugugaauggcagcugcuuuacaaucaugaccgauggccccucuaacggggcugccagcuacaaaaucuucaagauugaaaagggaaaagucacaaaguccaucgagcugaaugcuccuaacuuucacuaugaagaguguucuugcuacccggacaccggcaccgugaugugugugugccgggauaauuggcacgggagcaaccgccccuggcuuuccuucaaucagaaccuggacuaccaaauuggauauaucugcagcggcgucauuggggauaauccuagacccaaagacggaaagggcucuuguaacccuguuacaguggauggcgccgacggggugaaaggauuuuccuacaaguauggcaauggggucuggaucggacggacgaaaagcaaccgccucagaaagggcuucgagaugauuugggaccccaauggguggaccgauacagacucugauuuuuccgugaagcaggacguuguggcgaucaccgauuggagcggcuacuccggaucuuucguccagcauccggaacugacaggccuugacugcauccggccuuguuuuuggguggagcugguucgcgggcuccccagagaaaacaccacgauuuggacaagcggauccucuaucagcuucugcggcguggauggggacaccgccaauugguccuggccugauggagcugagcugcccuucaccauugacaaauga

SEQ ID NO: 199575 - RNA, 1413 nt, Artificial Sequence
  derived and/or modified sequence opt5 from neuraminidase__InfluenzaA__ACI32784
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucaauaucaacaauacaaacguuguggccggaaaagacaagaccucugugacacuggcgggcaauagcucccuuuguagcauuucugggugggcuaucuacaccaaagauaacuccauucggaucggaagcaagggcgacgucuucgugauucgcgaaccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacaggcaccaucaagucuuggaaaaagcagauucucagaacgcaggaauccgagugcguuuguaugaauggcagcugcuuuacaaucaugaccgaugggcccucuaacggagcugccagcuacaaaaucuucaagauugagaagggcaaagcuacaaaguccaucgaacugaaugccccuaacuuucacuaugaggaauguucuugcuacccggacaccgggaccgugaugugugucugccgggauaauuggcacggaagcaaccgccccuggguguccuucaaucagaaccuugacuaccaaauuggcuauaucugcagcgggguguuuggagauaauccuagacccaaagaccgggagggcucuuguaacccugucacaguugauggcgcggacggggugaagggauucuccuacaaauauggcaaugggguguggauuggacgcacgaaguccaacagacugcggaaaggcuuugagaugaucugggaccccaauggguggaccaacacagauucugacuucuccgucaagcaggaugugguugccauuaccgacuggagcggcuacuccggaucuuuugugcagcauccggaacucacaggccuggauugcauccgcccuuguuucugggucgagcuugugagagggcugccccgggaaaauaccacgaucuggacaagcggauccucuauuagcuucugcggcguuaacuccgacaccgcuaacuggagcuggccugauggggccgagcuccccuuuaccaucgacaaguga

SEQ ID NO: 199576 - RNA, 1413 nt, Artificial Sequence
  derived and/or modified sequence opt5 from neuraminidase__InfluenzaA__ACI32785
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaugugcaaccagagaaucauuaccuacgaaaauuccacaugggugaaccacaccuaugucaauaucaacaauacaaacguuguggccgagaaagacaagaccucugugacacuggcgggaaauagcucccuuuguagcaucucuggcugggcuauuuacaccaaagauaacuccauccggauugggagcaagggagacgucuucgugauccgcgagccuuuuauuucuugcucccaucuggaauguagaacguucuuucucacccaaggcgcccugcuuaaugauaaacacagcaacggcacaguuaaggaccggucuccguaucgcgcccugauguccugcccccucggggaggcuccuagccccuacaauuccaaguucgaaucuguggccuggagcgcuuccgccugucaugauggaaugggcuggcugaccaucgggaucagcggaccugacaacggcgcggucgccgugcugaaauauaacgggauuaucacagagaccauuaagucuuggaaaaagagaauccuccggacgcaggaguccgaaugcguuugugugaauggaagcugcuuuacaauuaugaccgauggccccucuaacggcgcugccagcuacaaaaucuucaagaucgagaaggggaaagucacaaaguccauugaacugaaugcuccuaacuuucacuaugaggaguguucuugcuacccggacaccggaaccgugaugugugugugccgcgauaauuggcacggcagcaacagacccugggucuccuucaaucagaaccuugacuaccagaucggguauauuugcagcggaguuuuuggcgauaauccucggcccaaagacgggaagggaucuuguaacccugugacaguggauggcgccgacggcgucaaaggguucuccuacaaguauggaaauggcguguggaucgggcgcacgaaaagcaacagacugcggaagggauuugaaaugauuugggaccccaauggcugggcggauaccgacucugauuucuccguuaagcaagacguggucgccaucacagauuggagcggguacuccggcucuuuugugcagcauccggagcucaccggacugaacugcauucgcccuuguuucuggguugaacuugugagaggccugccccgggagaauacaaccaucuggacgagcggguccucuaucagcuucugcggagucgacuccgauacagcuaacuggagcuggccugacggcgccgaacuccccuuuaccauugauaaauga

SEQ ID NO: 199577 - RNA, 1413 nt, Artificial Sequence
  derived and/or modified sequence opt5 from neuraminidase__InfluenzaA__ACI32787
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccagauucgaaucuguggccuggagcgcuuccgccugucacgauggaaugggcuggcugaccauugggaucagcggaccugacaacggcgcggucgccgugcugaaguauaaugggauuaucacagagaccauuaaaucuuggaagaaacggauccuccgcacgcaggaguccgaaugcguuuguaugaacggaagcugcuuuacaaucaugaccgauggccccucuaauggcgcugccagcuacaagauuuucaaaaucgagaaggggaaggugacaaaaaccauugaacugaacgcuccuaauuuucauuaugaggaguguuccugcuacccggacaccggaacagucaugugugugugcagagauaacuggcacggcucuaaucggcccugggugagcuucaaccagaaucuugacuaccagaucggguauauuugcuccggagucuuuggcgauaacccucgccccaaggacggggaaggaagcuguaauccuguuacgguggauggcgccgacggcgugaaaggguucucuuacaaguauggaaacggcgucuggaucgggagaaccaaauccaaucggcugcgcaagggauuugagaugauuugggaccccaacggcuggacaaauaccgauagcgacuucucugugaaacaagauguuguggcgaucacagacugguccggguacagcggcuccuuuguccagcacccggaacucaccggacuggauugcaucagaccuuguuucuggguggagcuuguucggggccugccccgcgaaaacacgacaauuuggaccucugggagcuccaucucuuucugcggagugaacggcgggaccgccgacuggagcuggccugauggagcugagcuccccuuuacaauugacaaguga

SEQ ID NO: 199578 - RNA, 1413 nt, Artificial Sequence
  derived and/or modified sequence opt5 from neuraminidase__InfluenzaA__ACI32788
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaccugcaaccagagaaucauuacauacgagaauaacaccugggugaaucacacaugugucaacaucaauaacaccaauguuguggccggaaaagacaagacauccgugacccuggucggcaacucuagccuuugcuccaucagcgggugggcgauuuauacgaaagauaauucuauccggauuggauccaagggcgacguguucguuauccgcgaaccuuuuauuagcuguucucaucuggagugcagaaccuucuuucucacacaaggcgcucugcuuaacgauaaacacuccaaugggaccgugaaggaccggagcccguaccgcgcccugaugucuuguccccucggagaagccccuucccccuauaacagcaaguucgaguccgucgcuuggucugccagcgcuugccaugauggcaaaggguggcugacaaucggaaucuccggcccugacaacggggccguggcgguucugaaguacaauggaauuaucaccgaaacgauuaaaagcuggaagaaaagaauccuccggacacaggagucugagugugugugcgucaacggcuccuguuuuaccauuaugacagauggccccagcaauggggccgcuucuuauaagaucuucaagaucgaaaaaggaaaggugaccaaaagcauugagcugaacgccccuaauuuucacuacgaagagugcuccuguuauccggacaccggcacagugaugugcgucugccgcgauaacuggcacgggucuaauagacccuggguuagcuucaaccagaaucuugacuaccagaucggauacauuuguuccggcguguuuggggauaacccucggcccaaggacggaaaaggcagcugcaauccuaugacgguggauggcgcugacggggucaagggauucucuuauaaauacggcaacgggguguggaucggacgcaccaaguccaauagacugcggaagggcuuugagaugauuugggaccccaacggguggacagauaccgacagcgauuucucuguuaaacaagacguggucgccaucacagauugguccggcuauagcggauccuuugugcagcauccggaacucaccggccuggacuguauucgcccuugcuucuggguugagcuugugagagggcugccccgggaaaauacgacaaucuggaccucuggaagcuccaucucuuucuguggcgucgauagcgacaccgcgaacugguccuggccugauggggccgagcuccccuuuacaauugacaaguga

SEQ ID NO: 199579 - RNA, 1410 nt, Artificial Sequence
  derived and/or modified sequence opt5 from neuraminidase__InfluenzaA__ACI32790
augaaccccaaucagaagaucauuaccaucggcagcgugucccugacaauugccacgaucugcuuccucacccaaauugcuauccuggucacaaccguuacacuucacuuuaaacaguacgaguguaacucuccuccgaauaaccaggugaugcugugcgaacccaccaucauugagagaaauaucacagaaauuguguaucucaccaacacgaccaucgagaaggaaauuuguccuaaacuggccgaguaccggaauuggagcaagccccagugcaacaucacaggguucgcgccuuuuuccaaagacaauucuauucgccuuagcgcuggaggcgauaucugggucaccagagagcccuauguguccugugacccugauaagugcuaccaauucgcccuggggcagggaacaacccucaacaauggccauucuaacgacacgguucacgaucggacaccguaucgcacccugcugaugaaugaacucggggugcccuuucaucugggaacaaagcaggucuguaucgccuggagcuccagcucuugccacgacggcaaggcuuggcuucauguguguguuaccggcgaugacaaaaacgccaccgcuuccuucauuuacaaugggagacugguggauagcaucggaucuugguccaaaaagauucuccggacacaggagagcgaaugcgucuguaucaacggcacgugcaccguggugaugacagacgggucugccuccggaaaagcggauaccaagauucuguuuaucgaggagggcaagaucguccacacaagccuucuguccgggucugcccaacacguugaagagugcagcuguuauccucgcuaccccggagugagaugcgugugucgggacaacuggaaaggcuccaaucgcccuauugucgauaucaacgugaaggacuacagcauuguuucuuccuaugugugcagcggccucgucggggacacccccagaaagaaugauucuagcuccucuagccauugucuggacccgaacaaugaagagggaggccacggggugaaaggaugggcuuucgaugacggcaacgauguuuggauggggcggacgaucuccgaaaaacugcgcagcggauacgagacauuuaaggugauugagggcuggucuaaaccuaauuccaagcuccagaucaacagacaggucaucguggaccggggcaaucgcagcggguauucuggaauuuucuccgucgaaggcaagagcugcaucaacagauguuuuuacguggagcugauucgggggagaaaucaggaaaccgagguucuuuggaccuccaacucuaucguggucuucugcggaacaagcggcaccuaugggacaggcuccuggcccgauggagccgacauuaaucugaugccuaucuga

SEQ ID NO: 199580 - RNA, 1410 nt, Artificial Sequence; identical to SEQ ID NO: 197406
  derived and/or modified sequence opt5 from neuraminidase__InfluenzaA__ACI32791

SEQ ID NO: 199581 - RNA, 1410 nt, Artificial Sequence; identical to SEQ ID NO: 197406
  derived and/or modified sequence opt5 from neuraminidase__InfluenzaA__ACI32793

SEQ ID NO: 199582 - RNA, 1410 nt, Artificial Sequence; identical to SEQ ID NO: 197406
  derived and/or modified sequence opt5 from neuraminidase__InfluenzaA__ACI32794

SEQ ID NO: 199583 - RNA, 1410 nt, Artificial Sequence; identical to SEQ ID NO: 197736
  derived and/or modified sequence opt5 from neuraminidase__InfluenzaA__ACI32795

SEQ ID NO: 199584 - RNA, 1410 nt, Artificial Sequence
  derived and/or modified sequence opt5 from neuraminidase__InfluenzaA__ACI32796
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguucuauuaccggguucgccccuuuuagcaaagacaacuccauccgccugucugcgggaggcgauaucugggugacaagagagcccuaugucagcugcgacccugauaaguguuaccaauucgcucuugggcagggaaccacacugaauaacgugcauuccaaugacaccguucacgaucggacgccguaucgcacacuccugaugaacgaacugggcgugcccuuucaucucgggaccaagcaggucugcauugccuggucuagcuccagcugucacgacggaaaagccuggcugcaugugugcguuacaggcgaugacaagaaugcuaccgccucuuucaucuacaacggcagacuuguggauuccauugucagcuggucuaaagagauccugcggacccaggaauccgagugugugugcauuaaugggacauguacgguggucaugaccgacggaagcgcuuccggcaaggccgauacaaaaauccucuuuaucgaggaagggaagauuguucacaccucuacacugagcggauccgcgcaacacguggaggaaugcagcugcuauccucgcuaccccggcgugagaugugucugccgggacaacuggaaggggucuaaccgcccuaucguggauauuaauaucaaagacuacuccauuguuagcucuuauguguguagcggacuugucggcgacacccccagaaagaacgauuccucuagcuccagccauugccuggacccgaauaacgaggaaggcgggcacggagugaaaggcugggccuucgaugacgggaaugauguuuggaugggacggacgaucucugagaagucccgcagcggcuacgagacauuuaaagugaucgaaggguggucuaacccuaauuccaagcuccagauuaacagacaggucaucguggaccggggaaaucgcagcggcuauuccggcauuuucucugucgaggggaaaagcuguaucaacagaugcuuuuacguggaacugauucggggaagaaaggaggaaaccgagguucuguggaccuccaauucuaucguggucuucuguggcacaagcgggaccuauggaacaggcuccuggcccgauggggcugacauuaaccucaugccuaucuga

SEQ ID NO: 199585 - RNA, 1410 nt, Artificial Sequence
  derived and/or modified sequence opt5 from neuraminidase__InfluenzaA__ACI32797
augaaccccaaucagaugaucauuaccaucggcagcgugucccugacaauuucuacgaucugcuucuuuaugcaaauugccauccucaucaccacagucacccugcacuucaagcaguacgaguuuaacagcccuccgaauaaccagguuaugcuuugugaacccacaauuaucgagagaaauauuaccgaaaucguguaucugacaaacaccacgauugagaaagaaaucugcccuaagcucgcugaguaccggaauugguccaaaccccaguguucuauuaccggguucgccccuuuuagcaaggacaacuccauccgccugucugcgggaggcgauaucugggugacaagagagcccuaugucagcugcgacccugauaaauguuaccaauucgcucuugggcagggaaccacacugaauaacgugcauuccaaugacaccguucacgaucggacgccguaucgcacacuccugaugaacgaacugggcgugcccuuucaucucgggaccaagcaggucugcauugccuggucuagcuccagcugucacgacggaaaggccuggcugcaugugugcguuacaggcgaugacaaaaaugcuaccgccucuuucaucuacaacggcagacuuguggauuccauugucagcuggucuaaggagauccugcggacccaggaauccgagugugugugcauuaaugggacauguacgguggucaugaccgacggaagcgcuuccggcaaagccgauacaaagauccucuuuaucgaggaagggaaaauuguucacaccucuacacugagcggauccgcgcaacacguggaggaaugcagcugcuauccucgcuaccccggcgugagaugugucugccgggacaacuggaaggggucuaaccgcccuaucguggauauuaauaucaaggacuacuccauuguuagcucuuauguguguagcggacuugucggcgacacccccagaaagaacgauuccucuagcuccagccauugccuggacccgaauaacgaggaaggcgggcacggagugaagggcugggccuucgaugacgggaaugauguuuggaugggacggacgaucucugagaaaucccgcagcggcuacgagacauuuaaggugaucgaaggguggucuaacccuaauuccaaacuccagauuaacagacaggucaucguggaccggggaaaucgcagcggcuauuccggcauuuucucugucgaggggaaaagcuguaucaacagaugcuuuuacguggaacugauucggggaagaaaagaggaaaccgagguucuguggaccuccaauucuaucguggucuucuguggcacaagcgggaccuauggaacaggcuccuggcccgauggggcugacauuaaccucaugccuaucuga

SEQ ID NO: 199586 - RNA, 1410 nt, Artificial Sequence
  derived and/or modified sequence opt5 from neuraminidase__InfluenzaA__ACI32798
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaacgagauccugcggacccaggaaucugagugugugugcauuaacgggacauguacgguggucaugaccgacggauccgcuagcggcaaagccgauacaaagauccucuuuaucgaggaagggaaaauuguucacaccuccacacugucuggaagcgcgcaacacguggaggaaugcuccugcuauccucgcuaccccggcgugagaugugucugccgggacaauuggaaggggagcaaccgcccuaucguggauauuaauaucaaggacuacucuauuguuuccagcuauguguguucuggacuugucggcgacacccccagaaagaacgauagcuccucuagcucccauugccuggacccgaauaacgaggaaggcgggcacggagugaaaggcugggccuucgaugacgggaaugauguuuggaugggacggacgaucagcgagaaacuccgcucuggcuacgagacauuuaaggugaucgaagggugguccaacccuaauagcaaacugcagauuaacagacaggucaucguggaccggggaaaucgcucuggcuauuccggcauuuucagcgucgaggggaaguccuguaucaacagaugcuuuuacguggaacugauucggggaagaaaagaggaaaccgagguucucuggaccucuaauagcaucguggucuucuguggcacauccgggaccuauggaacaggcucuuggcccgauggggcugacauuaaccugaugccuaucuga

SEQ ID NO: 199587 - RNA, 1410 nt, Artificial Sequence
  derived and/or modified sequence opt5 from neuraminidase__InfluenzaA__ACI32799
augaaccccaaucagagaaucauuaccaucggcagcgugucccugacaauuucuacgaucugcuucuuuaugcaaauugccauccucaucaccacagucacccugcacuucaagcaguacgaguuuaacagcccuccgaauaaccagguuaugcuuugugaacccacaauuaucgagcggaauauuaccgaaaucguguaucugacaaacaccacgauugagaaagaaaucugcccuaagcucgcugaguaccgcaauugguccaaaccccagugugacauuaccggguucgccccuuuuucuaaggauaacagcaucagacuguccgcgggaggcgacaucugggugacacgggagcccuaugucucuugcgauccugacaaauguuaccaauucgcucuugggcagggaaccacacugaauaacgugcauagcaaugauaccguucacgaccgcacgccguauagaacacuccugaugaacgaacugggcgugcccuuucaucucgggaccaagcaggucugcauugccugguccagcagcuccugucacgauggaaaggccuggcugcaugugugcguuacaggcgacgauaaaaaugcuaccgccagcuucaucuacaacggccggcuuguggacucugucguguccuggagcaaggauauucugcgcacccaggagucugaaugugugugcaucaaugggacauguacggucguuaugaccgacggauccgcuagcggcaaagccaacacaaagauucucuuuaucgaggaggggaaaaucgugcacaccuccacacugucuggaagcgcgcaacacguggaagagugcuccugcuauccuagauaccccggcguccggugugugugccgcgauaacuggaaggggagcaauagaccuauuguugacaucaacauuaagaauuacucuaucguguccagcuaugucuguucuggacuugugggcgacacgccccggaaaaccgauagcuccucuagcucccauugccuggacccgaacaaugaagagggcgggcacggaguuaagggcugggccuucgaugacgggaacgauguguggaugggacgcacaauuagcgaaaaacucagacugggcuacgagaccuuuaaggucaucgagggguggucuaauccuaacuccaaacugcagaucaaucgccaggugauugucgaccggggaaacagaagcggcuauucuggcaucuucuccguggaagggaagucuuguauuaaucggugcuuuuacguugagcucaucagaggacgcaaagaagagaccgaagugcuguggacauccaacucuauugucguguucuguggcaccagcgggacauauggaacgggcuccuggcccgauggggcugacaucaaucuuaugccuauuuga

SEQ ID NO: 199588 - RNA, 1410 nt, Artificial Sequence
  derived and/or modified sequence opt5 from neuraminidase__InfluenzaA__ACI32800
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagaccaauagacaggucauuguggaccggggaaaccgcucuggcuauuccggcaucuucagcgucgaggggaaauccuguauuaauagaugcuuuuacguggaacugauccggggaagaaaggaggaaaccgagguucucuggacaucuaacagcauuguggucuucuguggcaccuccgggacauauggaacgggcucuuggcccgauggggcugacaucaaucugaugccuauuuga

SEQ ID NO: 199589 - RNA, 1410 nt, Artificial Sequence; identical to SEQ ID NO: 199588
  derived and/or modified sequence opt5 from neuraminidase__InfluenzaA__ACI32802

SEQ ID NO: 199590 - RNA, 1410 nt, Artificial Sequence; identical to SEQ ID NO: 199588
  derived and/or modified sequence opt5 from neuraminidase__InfluenzaA__ACI32803

SEQ ID NO: 199591 - RNA, 1410 nt, Artificial Sequence; identical to SEQ ID NO: 198731
  derived and/or modified sequence opt5 from neuraminidase__InfluenzaA__ACI32804

SEQ ID NO: 199592 - RNA, 1410 nt, Artificial Sequence
  derived and/or modified sequence opt5 from neuraminidase__InfluenzaA__ACI32805
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccagcagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccguuacaaaaauccucuuuaucgaggaagggaagauugugcacaccuccacacugucuggaagcgcgcaacacguggaggaaugcuccugcuauccucgcuaccccggcgucagaugugugugccgggauaacuggaaggggagcaaucgcccuaucguugacauuaacaucaaagauuacucuauuguguccagcuaugucuguucuggacuugugggcgacacccccagaaagaaugaccggagcuccucuagccauugccuggauccgaacaaugaggaaggcgggcacggaguuaaaggcugggccuucgacgaugggaacgacguguggaugggacgcacgaucuccgagaagucuagaucuggcuacgagacauuuaaagucaucgaagggugguccaauccuaacagcaagcuccagaccaaucgccaggugauugucgaucggggaaacagaucuggcuauuccggcaucuucagcguggaggggaaauccuguauuaaucggugcuuuuacguugaacugaucagaggacgcaaggaggaaaccgaggugcuguggacaucuaacagcauugucguguucuguggcaccuccgggacauauggaacgggcucuuggcccgacggggcugauaucaaucucaugccuauuuga

SEQ ID NO: 199593 - RNA, 1410 nt, Artificial Sequence; identical to SEQ ID NO: 197736
  derived and/or modified sequence opt5 from neuraminidase__InfluenzaA__ACI32806

SEQ ID NO: 199594 - RNA, 1410 nt, Artificial Sequence
  derived and/or modified sequence opt5 from neuraminidase__InfluenzaA__ACI32807
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcgggaccgcacgccguauagaacacuccugaugaacgaacugggcguccccuuucaccucgggaccaaacaggugugcaucgccugguccucuagcuccugucaugauggaaaggccuggcugcacguuugcauuacaggcgacgauaagaaugcuaccgccagcuucaucuacaacggccggcuuguggacucuauugucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaauagcaagcugcagauuaaccggcaggucaucguggaucgcggaaauagaucuggcuacuccggcauuuucagcgucgaggggaaauccuguaucaaccggugcuuuuauguggaacugauuagaggacgcaaggaggaaaccgagguucucuggaccucuaauagcaucguggucuucuguggcacauccgggaccuacggaacaggcucuuggcccgacggggcugauauuaaccugaugccuaucuga

SEQ ID NO: 199595 - RNA, 1410 nt, Artificial Sequence
  derived and/or modified sequence opt5 from neuraminidase__InfluenzaA__ACI32808
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacaccuccacacugucuggaagcgcgcaacacguggaagagugcuccugcuauccucgcuaccccggcgucagaugugugugccgggacaacuggaaggggagcaaccgcccuauuguugacaucaauauuaaaaacuacucuaucguguccagcuaugucuguucuggacuugugggcgauacccccagaaagacggacagcuccucuagcucccauugccuggauccgaauaacgaagagggcgggcacggaguuaaaggcugggccuucgacgaugggaaugacguguggaugggacggacaauuagcgaaaagcuccgccugggcuacgagaccuuuaaagucaucgagggguggucuaacccuaauuccaagcugcagaucaacagacaggugauugucgaucggggaaaucgcagcggcuauucuggcaucuucuccguggaagggaaaagcuguauuaacagaugcuuuuacguugagcucauccggggaagaaaggaaaagaccgaggugcuguggacauccaauucuauugucguguucuguggcaccagcgggacauauggaacgggcuccuggcccgacggggcugauaucaaccuuaugccuauuuga

SEQ ID NO: 199596 - RNA, 1410 nt, Artificial Sequence; identical to SEQ ID NO: 198731
  derived and/or modified sequence opt5 from neuraminidase__InfluenzaA__ACI32809

SEQ ID NO: 199597 - RNA, 1410 nt, Artificial Sequence
  derived and/or modified sequence opt5 from neuraminidase__InfluenzaA__ACI32810
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccgcaucgcacacuccugaugaacgaacugggcgugcccuuucaccucgggaccaagcaggucugcauugccugguccucuagcuccugucaugauggaaaagccuggcugcacgugugcguuacaggcgacgauaagaaugcuaccgccagcuucaucuauaacggcagacuuguggacucugucguguccuggagcaaagauauucugcggacccaggagucugaaugugugugcaucaaugggacauguacggucguuaugaccgacggauccgcuagcggcaaggccgauacaaaaauucucuuuaucgaggaggggaagaucgugcacaccuccacacugucuggaagcgcgcaacauguggaagagugcuccugcuacccucgcuaucccggcgucagaugugugugccgggacaacuggaaggggagcaaccgcccuauuguugacaucaauauuaaaaacuacucuaucguguccagcuacgucuguucuggacuugugggcgauacccccagaaagacggacagcuccucuagcucccacugccuggauccgaauaacgaagagggcgggcauggaguuaaaggcugggccuucgacgaugggaaugacguguggaugggacggacaauuagcgaaaagcuccgccugggcuaugagaccuuuaaagucaucgagggguggucuaacccuaauuccaagcugcagaucaacagacaggugauugucgaucggggaaaucgcagcggcuacucuggcaucuucuccguggaagggaaaagcuguauuaacagaugcuuuuauguugagcucauccggggaagaaaggaagagaccgaagugcuguggacauccaauucuauugucguguucuguggcaccagcgggacauacggaacgggcuccuggcccgacggggcugauaucaaccuuaugccuauuuga

SEQ ID NO: 199598 - RNA, 1410 nt, Artificial Sequence
  derived and/or modified sequence opt5 from neuraminidase__InfluenzaA__ACI32811
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaagagcaaacugcagauuaacagacaggucaucguggaccggggaaaucgcucuggcuauuccggcauuuucagcgucgaggggaaguccuguaucaacagaugcuuuuacguggaacugauucggggaagaaaggaggaaaccgagguucucuggaccucuaauagcaucguggucuucuguggcacauccgggaccuauggaacaggcucuuggcccgauggggcugacauuaaccugaugccuaucuga

SEQ ID NO: 199599 - RNA, 1410 nt, Artificial Sequence
  derived and/or modified sequence opt5 from neuraminidase__InfluenzaA__ACI32812
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucugucguguccuggagcaaagauauucugcggacccaggagucugaaugugugugcaucaaugggacauguacggucguuaugaccgacggauccgcuagcggcaaggccaacacaaaaauucucuuuaucgaggaggggaagaucgugcacaccuccacacugucuggaagcgcgcaacacguggaagagugcuccugcuauccucgcuaccccggcgucagaugugugugccgggauaacuggaaggggagcaaucgcccuauuguugacaucaacauuaaaaauuacucuaucguguccagcuaugucuguucuggacuugugggcgacacccccagaaagacggauagcuccucuagcucccauugccuggacccgaacaaugaagagggcgggcacggaguuaaaggcugggccuucgaugacgggaacgauguguggaugggacggacaauuagcgaaaagcuccgccugggcuacgagaccuuuaaagucaucgagggguggucuaauccuaacuccaagcugcagaucaauagacaggugauugucgaccggggaaaccgcagcggcuauucuggcaucuucuccguggaagggaaaagcuguauuaauagaugcuuuuacguugagcucauccggggaagaaaggaagagaccgaagugcuguggacauccaacucuauugucguguucuguggcaccagcgggacauauggaacgggcuccuggcccgauggggcugacaucaaucuuaugccuauuuga

SEQ ID NO: 199600 - RNA, 1410 nt, Artificial Sequence; identical to SEQ ID NO: 197823
  derived and/or modified sequence opt5 from neuraminidase__InfluenzaA__ACI32814

SEQ ID NO: 199601 - RNA, 1350 nt, Artificial Sequence
  derived and/or modified sequence opt5 from neuraminidase__InfluenzaA__ACJ53848
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgaucggaauuuccggcccugauaacggggccguugcggugcugaaguacaauggaaucauuaccgacacaaucaagagcuggcggaacaauauucuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagaucacgugcgugugcagagacaacuggcacgggagcaaccggcccuggguguccuucaaucagaaccuugaauaucaaauuggauacaucuguagcggcgucuuuggggauaauccucgccccaacgacggaacaggcucuugcgggccgguguccccuaauggagccuacggcguuaagggcuucagcuuuaaguaugggaacggaguguggauuggcagaaccaaaucuacaaauucccggagcggguucgagaugaucugggaucccaacggauggaccggcaccgacuccucuuuuagcgucaagcaggacauuguggcgaucacagauugguccggguacucuggcagcuucguucagcacccugaacugacgggacucgacuguauccgccccugcuucuggguggagcugauuagaggccggcccaaagaauccaccaucuggacaagcgggucuuccauuagcuuuuguggagucaauucugauaccguguccuggagcuggccugacggcgccgagcuuccguucacaaucgauaaguga

SEQ ID NO: 199602 - RNA, 1350 nt, Artificial Sequence
  derived and/or modified sequence opt5 from neuraminidase__InfluenzaA__ACJ53849
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgaucggaauuuccggcccugauaacggggccguugcggugcugaaguacaauggaaucauuaccgacacaaucaagagcuggcggaacaauauucuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagaucacgugcgugugcagagacaacuggcacgggagcaaccggcccuggguguccuucaaucagaaccuugaauaucaaauuggauacaucuguagcggcgucuuuggggauaauccucgccccaacgacggaacaggcucuugcuccccggugagcccuaauggggccuacggaguuaagggcuucucuuuuaaguauggcaacgggguguggauuggaagaaccaaauccacaaauagccgguccggcuucgagaugaucugggaucccaacggguggaccggaaccgacucuagcuuuuccgucaagcaggacauuguggcgaucacagauuggucuggcuacagcggguccuucguucagcacccugaacugacgggccucgacuguauccgccccugcuucuggguggagcugauuagaggacggcccaaagaaagcaccaucuggacaucuggcuccagcauuucuuuuuguggggucaauuccgauaccgugagcuggucuuggccugacggagccgagcuuccguucacaaucgauaaguga

SEQ ID NO: 199603 - RNA, 1350 nt, Artificial Sequence
  derived and/or modified sequence opt5 from neuraminidase__InfluenzaA__ACJ53853
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauucuccgcacccaggagucugagugugcgugcgucaacggcuccuguuucacagugaugaccgacgggccgagcucuggacaggccagcuauaaaaucuuuaagauggaaaaaggcaagguggucaaauccguugagcuggaugcucccaauuaccauuaugaagagugcucuuguuacccugacgccggcgagaucacgugcgugugcagagauaacuggcacgggagcaaccggcccuggguguccuucaaucagaaccuugaauaucaaauuggauacaucuguagcggcgucuuuggggacaauccucgccccaacgauggaacaggcucuugcgggccgguguucccuaauggagcuuacggcguuaagggcuuuuccuucaaguaugggaacggaguguggauuggcagaaccaaaagcacaaauucucgguccggguuugagaugaucugggaccccaacggauggaccggcaccgacagcuccuucucugucaagcaggauauuguggccaucacagacuggagcggguacuccggcucuuucguucagcacccugaacugacgggacucgauuguauccgccccugcuuuuggguggagcugauuagaggccggcccaaagaaagcaccaucuggacauccgggagcucuauuuccuucuguggagucaauagcgacaccgugucuugguccuggccugauggcgcggagcuuccguuuacaaucgacaaguga

SEQ ID NO: 199604 - RNA, 1350 nt, Artificial Sequence; identical to SEQ ID NO: 199603
  derived and/or modified sequence opt5 from neuraminidase__InfluenzaA__ACJ53866

SEQ ID NO: 199605 - RNA, 1350 nt, Artificial Sequence
  derived and/or modified sequence opt5 from neuraminidase__InfluenzaA__ACJ53867
augaaccccaaucagaagaucauuaccaucggcagcauuugcauggccaucgggauugugucccugaugcuccaaaucggaaacaugaucucucugugggucagccacuccauucagacaggcaaucagugucaggcugagccuaucucuaacacgaaauuccuuaccgaaaaggccguugcgagcgugacacuggcuggaaauuccucucucugcccgauuagcgggugggccguguacuccaaagacaacagcaucagaauuggcucucgcggggaugucuuugugauccgggagcccuucauuuccuguagccaucuggaaugcagaaccuuuuuccuuacacaaggagcccugcucaaugacaagcacucuaacggcaccguuaaagaucgguccccucaucgcacacugaugagcugucccgugggcgaggcuccuucucccuauaauuccagauuugaaagcgucgccugguccgcuucugccugccacgacgggaccagcuggcugacgaucggaaucuccggcccugauaacggggcgguggccguucucaaguacaauggaauuaucaccgacacaauuaagagcuggcggaacaauauccugcgcacccaggagucugagugugcuugcgugaacggcuccuguuucacagucaugaccgaugggccgagcucuggacaggccagcuauaaaauuuuuaagauggaaaaaggcaagguggugaaauccgucgagcuugacgcucccaauuaccauuaugaagagugcucuuguuacccugaugccggcgagaucacgugcguuugcagagacaacuggcacgggagcaaccggcccuggguguccuucaaucagaaccuggaauaucaaaucggauacauuuguagcggcguguuuggggauaauccucgccccaacgacggaacaggcucuugcgggccggucuccccuaauggagcguacggcgugaagggcuucagcuuuaaguaugggaacggaguuuggaucggcagaaccaaaucuacaaauucccggagcggguucgagaugauuugggaucccaacggauggaccggcaccgacuccucuuuuagcgugaagcaggacaucgucgccauuacagauugguccggguacucuggcagcuucgugcagcacccugaacucacgggacuggacuguauccgccccugcuucuggguugagcuuaucagaggccggcccaaagaauccaccauuuggacaagcgggucuuccaucagcuuuuguggagucaauucugauaccguguccuggagcuggccugacggcgcugagcugccguucacaauugauaaguga

SEQ ID NO: 199606 - RNA, 1350 nt, Artificial Sequence
  derived and/or modified sequence opt5 from neuraminidase__InfluenzaA__ACJ53875
augaaccccaaucagaagaucauuaccaucggcagcauuugcauggugaucgggauugucucccugaugcuccaaaucggaaacaugaucucuauuuggguuagccacuccauccagacaggcaaucagugucaggccgagccuauuucuaacacgaaauuccugaccgaaaaggcuguggccagcgugacacuugcgggaaauuccucucugugcccgaucagcgggugggcugucuacuccaaagacaacagcauuagaaucggcucucgcggggauguguuuguuauucgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaucagcuggcugaccauuggaaucuccggcccugauaacggggccguugcggugcugaaguacaauggaauuaucacggacaccauuaagagcuggcggaacaauauccuccgcacacaggagucugagugugccugcgucaacggcuccuguuucaccgugaugacagaugggccgagcucuggacaggcuagcuauaaaaucuuuaagauggaaaaaggcaagguggucaaauccguugagcuggaagcccccaauuaccauuaugaggagugcucuuguuacccugacgcuggcgaaauuaccugcgugugcagagauaacuggcacgggagcaaccggcccuggguguccuucaaucagaaccuugaguaucaaaucggauacauuuguagcggcgucuuuggggacaauccucgccccaacgauggaacgggcucuugcgggccgguguccccuaauggagccuacggcguuaagggcuucagcuuuaaguaugggaacggaguguggaucggcagaacaaaaucuaccaauucccggagcggguucgaaaugauuugggaccccaacggauggacaggcaccgauuccucuuuuagcgucaagcaggacaucguggcgaucaccgacugguccggguacucuggcagcuucguucagcacccugagcugacaggacucgauuguauucgccccugcuucuggguggaacugaucagaggccggcccaaagaguccacgauuuggaccagcgggucuuccaucagcuuuuguggagucaauucugacacaguguccuggagcuggccugauggcgccgagcuuccguucaccauugacaaguga

SEQ ID NO: 199607 - RNA, 1350 nt, Artificial Sequence
  derived and/or modified sequence opt5 from neuraminidase__InfluenzaA__ACJ53876
augaaccccaaucagaagaucauuaccaucggcagcauuugcauggugaucgggauugucucccugaugcuccaaaucggaaacaucauuucuaucuggguuagccacuccauucagacaggcaaucagugucaggccgagccuaucucuaacacgaaauuccugaccgaaaaggcuguggccagcgugacacuugcgggaaauuccucucugugcccgauuagcgggugggcugucuacuccaaagacaacagcaucagaauuggcucucgcggggauguguuuguuauccgggagcccuucaucuccuguagccaucucgaaugcagaaccuuuuuccugacacaaggagcccuucugaaugacaagcacucuaacggcaccgugaaagaucgguccccucaucgcacacucaugagcugucccgucggcgaggccccuucucccuauaauuccagauuugaaagcguggcuugguccgccucugcuugccacgacgggaccagcuggcugacgauuggaaucuccggcccugauaacggggccguugcggugcugaaguacaauggaauuaucaccgacacaauuaagagcuggcggaacaauauccuccgcacccaggagucugagugugccugcgucaacggcuccuguuucacagugaugaccgaugggccgagcucuggacaggcuagcuauaaaaucuuuaagauggaaaaaggcaagguggucaaauccguugagcuggacgcccccaauuaccauuaugaagagugcucuuguuacccugaugcuggcgagauuacgugcgugugcagagacaacuggcacgggagcaaccggcccuggguguccuucaaucagaaccuugaauaucaaaucggauacauuuguagcggcgucuuuggggauaauccucgccccaacgacggaacaggcucuugcgggccgguguccccuaauggagccuacggcguuaagggcuucagcuuuaaguaugggaacggaguguggaucggcagaaccaaaucuacaaauucccggagcggguucgagaugauuugggaucccaacggauggaccggcaccgacuccucuuuuagcgucaagcaggacaucguggcgaucacagauugguccggguacucuggcagcuucguucagcacccugaacugacgggacucgacuguauucgccccugcuucuggguggagcugaucagaggccggcccaaagaauccaccauuuggacaagcgggucuuccaucagcuuuuguggagucaauucugauaccgugggcugguccuggccugacggggccgagcuuccguucacaauugauaaguga

SEQ ID NO: 199608 - RNA, 1404 nt, Artificial Sequence
  derived and/or modified sequence opt5 from neuraminidase__InfluenzaA__ACJ67535
augaaccccaaucagaagaucauugcccugggcagcguguccaucaccauugcuacaaucugccucauuaugcaaaucgccguccuggcgacgaccaugacacuucacuucaacgaguguaccaauccuucuaacaaucaggcuaugccgugcgaacccaucauuaucgagagaaacaugacagaaauuguucaucugaauaacaccacaaucgagaaagaaagcuguccuaagguggccgaguacaaaaauugguccaagccccagugccagauuaccggguuugccccuuucucuaaagacaacagcauccggcucuccgcuggaggcgauauuugggugacgcgcgagcccuaugucucuugugggcugggaaauugcuaccaauuugcccuuggccaggggaccacacugaacaauaagcacagcaacgacaccauccaugauagauccccucaccggacacuccugaugaaugaacugggagugccguuccaucucggcaccaagcagguuuguaucgcuuggucuagcuccagcugccacgacggcaaagccuggcugcacgugugugucacgggggaugaccgcaacgcgacagccucuauuaucuaugauggaaugcuuaccgacuccauuggcagcuggucuaagaacauccugagaacacaggaguccgaaugcguguguauuaaugggaccugcaccguugugaugacagauggaagcgcuuccggccgggccgacacgaaaauccucuuuauccgcgaggggaagauuguccauaucucuccccugagcggauccgcucaacacguggaggaaugcagcuguuacccuagauaucccgaggugcggugcgucugucgcgauaacuggaaaggcucuaauagaccuguucuuuacauuaacguggccgacuauuccguggauagcucuuacgucugcagcggccuggugggggacacaccccggaaugacgauuccucuagcuccagcaacugucgcgacccgaauaacgaaagaggaggcccugggguuaagggaugggcguucgauaauggcaacgacguguggauggggcggaccaucaagaaagauucucgcuccggauacgagaccuuuagagucgugggcggcuggacaaccgccaauagcaagucucagauuaaccggcagguuaucguggacuccgauaauuggagcggguauuccggaaucuucucugucgaaggcaaaacgugcauuaacagauguuuuuacguggagcucauccgcgggcggccccaggagacaagagucugguggaccagcaauuccauuaucguguucugcggaaccucuggcacauaugggaccggcagcuggccugacggagcuaacauuaacuuuauguccaucuga

SEQ ID NO: 199609 - RNA, 1410 nt, Artificial Sequence
  derived and/or modified sequence opt5 from neuraminidase__InfluenzaA__ACK99424
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucaggugauccccugccagccuacaauuaucgaaagaaacauuaccgagaucguguaucugacaaauaccacgauugaaaaggagaucugucccaaacucgucgaauaccggaacugguccaagccucaaugcaaaauuaccggguucgcccccuuuucuaaggacaauagcauccgccuguccgcgggaggcgauaucugggugacaagagagccuuauguuucuugugacccgagcaagugcuaccaguucgcucuugggcagggaaccacacugaacaaucggcauuccaacgauaccgugcacgaccgcacgcccuauagaacacuccugaugaaugagcugggcgucccuuuucaucucgggaccaaacagguguguauugccuggucuagcuccagcugccacgauggaaaggccuggcugcauguuugugugacaggccacgacgaaaacgcuaccgccucuuucaucuacgauggccggcuugucgacuccauugggagcuggucuaaaaauauccugcgcacccaagaguccgaaugcguguguauuaacggaacaugcacgguggucaugaccgauggcagcgcuuccgagagagccgacacaaagauccucuuuaucgaggaagggaaaguugugcacauuucuccccugagcggauccgcgcagcauguggaggaaugcagcuguuauccucgguaccccggcguccgcugcguguguagagauaauuggaaggggucuaaccggccgaucguugacauuaacgugaaggauuacuccaucgucagcucuuaugugugcagcggacuuguuggcgacaccccucgcaaaaaugacuccucuagcuccagcuacuguagaaaccccaauaacgagaagggcucucacggggugaaaggaugggccuucgaugacggcaaugaugucuggauggggcggacaauuuccgaggaacugcgcagcggauaugagaccuuuaaggugaucggcggguggucuacgccuaacuccaaacuccagaucaauagacaggucauuguggacagcggaaaccgguccggcuacucuggcaucuucagcguugaagggaaguccugcauuaauagauguuuuuauguggagcugauccgcggacggaaacaagaaacaaaggucugguggaccucuaacagcauugugguuuucugcggcaccuccgggacauacggaaccggcagcuggcccgauggggcugacaucaaucugaugcccauuuga

SEQ ID NO: 199610 - RNA, 1410 nt, Artificial Sequence; identical to SEQ ID NO: 199429
  derived and/or modified sequence opt5 from neuraminidase__InfluenzaA__ACK99435

SEQ ID NO: 199611 - RNA, 1413 nt, Artificial Sequence
  derived and/or modified sequence opt5 from neuraminidase__InfluenzaA__ACK99446
augaaccccaaucagaagaucauuaccaucggcagcauuuccauggccaucgggauuaucucucugacacuccaaaucggaaacauuaucagcauuugggugucccacucuauccagacgggcagccagaaucauaccgggauuugcaaccagagaaucauuacauacgaaaauuccaccugggucaaccaaacauauguuaauaucaacaauaccaacgugguggcuggaaaagacaagacaucugucacccuggccggcaauagcucccuuuguccuauccgggggugggcgauuuacacgaaagauaacagcauccgcauuggaucuaagggcgacguguucguuaucagagagccguuuauuuccugcagccaccuggagugucggaccuucuuucucacacagggcgcucugcuuaaugauaaacauucuaacgggaccgugaaggaccgcagcccccacagagcccugauguccugcccucucggagaagcccccucuccuuauaauucccgguucgagagcgucgcuugguccgccucugcuugucaugauggcaugggguggcugacaaucggaaucagcggccccgacgauggggccguggcgguucugaaguacaacggaauuaucaccgaaacgauuaaauccuggaagaaacgcauccucagaacacaggagagcgagugcgugugugucaacggcucuugcuuuaccauuaugacagacggcccuuccaauggggccgcuagcuaucggaucuucaagaucgaaaaaggaaaggugaccaagucuauugagcuggaugccccgaacagccacuacgaagaguguuccugcuaucccgacaccggcacagugaugugugucugccgcgauaauuggcacgggucuaacagaccuuggguuagcuuuaaucagaaccuugacuaccaaaucggauacauuugcuccggcguguucggggauaauccccggccuaaagacggaaagggcagcuguaaccccgugacggucgacggcgcugauggggugaaaggauuuucuuaucgcuacggcaaugggguuuggaucggaagaaccaaguccaaccgguuccgcaaaggcuuugagaugauuugggacccgaauggguggacagauaccgacagcgauuucucugugaagcaggacgucguggccaugacagauugguccggcuauagcggauccuuuguucagcauccugaacugaccggccucgacugcaugagacccuguuucuggguggagcugguccgggggagaccucgcgaaaacacgacaaucuggaccucuggaagcuccauuucuuucugcggcgugaauagcgauaccgcgaacugguccuggcccgacggggccgagcuucccuuuacaaucgauaaauga

SEQ ID NO: 199612 - RNA, 1410 nt, Artificial Sequence
  derived and/or modified sequence opt5 from neuraminidase__InfluenzaA__ACK99457
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcccugcgaaccuacaaucauugagagaaauaucaccgaaauuguguaccugacaaacaccacgaucgagaaggaaauuugucccaaacucgucgaguaucggaauuggagcaagccucagugcaaaaucaccggguucgcccccuuuuccaaggacaacucuauucgccugagcgcgggaggcgauaucugggugacaagagagccuuacguuuccugugacccggggaagugcuaucaauucgcucuuggacagggcaccacacugaauaaccggcacucuaaugauaccgugcaugaccgcacgcccuacagaacacuccugaugaacgaacugggggucccuuuucaccucggaaccaaacagguguguaucgccuggagcuccagcucuugccaugauggcaaggccuggcugcacguuugugugacaggccacgacgagaaugcuaccgccuccuucauuuaugaugggcggcuugucgacagcaucgugucuugguccaaaaacauucugcgcacccaggaaagcgagugcguguguaucaauggaacaugcacggucguuaugaccgauggcucugcuuccgagagagccgacacaaagauucucuuuaucgaagaggggaaaaucgugcauauuagcccccuguccggaucugcgcaacacguggaagagugcagcuguuacccucgguaucccggcguccgcugcguguguagagauaacuggaagggguccaaccggccgaucguugacauuaaugugaaggauuacagcaucgucucuuccuacgugugcagcggacuuguuggcgacaccccucgcaaaaacgacucuagcuccucuagcuauuguagaaaucccaacaaugaaaagggcucccauggggugaaaggaugggccuucgaugacggcaacgaugucuggauggggcggacaauuggagaggagcugcgcagcggcuacgaaaccuuuaaggugaucgggggauggucuacgccuaauuccaaacuccagacaaacagacaggucaucguggaccggggcaauagaagcggcuauucugggauuuucuccguugagggaaagagcugcaucaaccgcuguuuuuacguggaacugauucggggcagaaaacaggagaccaaggucugguggaccuccaauucuaucgugguuuucugcgggacaagcggaaccuauggcacaggguccuggcccgauggcgcugacauuaaccugaugcccaucuga

SEQ ID NO: 199613 - RNA, 1413 nt, Artificial Sequence
  derived and/or modified sequence opt5 from neuraminidase__InfluenzaA__ACK99468
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaaccaaaccuaugucaauauuaacaauacaaacguuguggccggaaaagacaagaccucuaugacacuggcgggcaauagcucccuuuguccuauccgggggugggcuauuuacaccaaagauaacagcauccgcauuggaucuaagggcgacguguucgucaucagagagccguuuaucuccugcagccaccuggagugucggacguucuuucucacccagggcgcccugcuuaaugauaaacauucuaacgggacagugaaggaccgcucccccuauagagcccugaugagcugcccucucggagaagcucccucuccuuacaauucccgguucgagagcguugccugguccgcuucugccugucacgauggccugggguggcugaccauuggaaucagcggccccgacaacggggcgguggccguccucaaguauaacggaauuaucacagaaaccauuaaauccuggaagaaacgcauccugagaacgcaggagagcgagugcguguguaugaacucuuccugcuuuacaaucaugaccgauggcccuagcaauggcgcugccucuuaccggauuuucaagaucgaaaaagggcgcguuacaaagagcauugagcuugacgcuccgaauuaucauuacgaagaguguuccugcuaccccgauaccggaaccgugaugugugucugcagagacaacuggcacggcucuaaucggccuugggugagcuuuaaccagaaucuggauuaucaaaucggguacauuugcuccggaguguucggcgacaacccccgcccuaaggauggggagggaagcuguaaucccgucacaguugacggcgccgacggcgugaaaggguuuucuuauagauacggaaacggcguguggaucgggcggacgaaguccaaucgccucagaaaaggauucgaaaugauuugggauccgaacggcuggaccgacacagauagcgacuuuucuaugaagcaggauaucgucgcgaugaccgacugguccggguauagcggcuccuucgugcagcacccugagcugacaggacuugauugcaugcggcccuguuuuuggguugaacuggugagaggccucccucgcgagaauaccacgaucuggacaucugggagcuccauuucuuucugcggagucaacagcgacaccgccaauugguccuggcccgauggcgcugaacugcccuucaccaucgacaaauga

SEQ ID NO: 199614 - RNA, 1410 nt, Artificial Sequence
  derived and/or modified sequence opt5 from neuraminidase__InfluenzaA__ACK99479
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaaaaucaccggguucgcgccuuuuuccaaggacaacucuauucgccuuagcgcuggaggcgauaucugggucacaagagagcccuauguguccugugacccugauaagugcuaccaauucgcccuggggcagggaaccacacucaauaaccggcauucuaaugacaccguucacgaucgcacgccguauagaacacugcugaugaacgaacucggcgugcccuuucaucuggggaccaaacaggucuguaucgccuggagcuccagcucuugccacgacggaaaggcuuggcuucauguguguguuacaggccacgaugagaaugccaccgcuuccuucauuuacgacggccggcugguggauagcaucgggucuugguccaaaaagauucuccgcacccaggaaagcgagugcgucuguaucaacggaacaugcacgguggugaugaccgacggcucugccuccgggagagcggauacaaaaauucuguuuaucgaggaaggaaagaucguccacauuagcccucuucugggcuccgcccaacauguugaggaaugcucuuguuauccccgguacccuggggugcgcugcguguguagagacaauuggaagggaagcaaccggcccaucgucgauauuaacgugaaagacuacuccaucguuagcucuuaugugugcuccggccucgucggcgacaccccgcgcaagaaugauagcucuagcuccucucacugucugaacccuaauaacgaggaagggggacauggcgugaaagggugggcuuucgacgauggaaaugacguuuggaugggcagaacaauuagcgagaagcugcgguccggguacgagaccuuuaaagugaucgaaggauggagcaagcccaacucuaaacuccagaucaaucgccaggucauuguggauagaggcaaccgguccggcuauagcgggaucuucucugucgagggaaaguccugcauuaauagauguuuuuacguggaacugauccgcggccggaagcaggagacggaaguuugguggacaagcaacuccauuguggucuucugcgggaccucuggaaccuauggcacagggagcuggccugacggcgccaauaucaaccuuaugcccauuuga

SEQ ID NO: 199615 - RNA, 1413 nt, Artificial Sequence; identical to SEQ ID NO: 199308
  derived and/or modified sequence opt5 from neuraminidase__InfluenzaA__ACL12066

SEQ ID NO: 199616 - RNA, 1410 nt, Artificial Sequence; identical to SEQ ID NO: 198209
  derived and/or modified sequence opt5 from neuraminidase__InfluenzaA__ACL12132

SEQ ID NO: 199617 - RNA, 1413 nt, Artificial Sequence; identical to SEQ ID NO: 199542
  derived and/or modified sequence opt5 from neuraminidase__InfluenzaA__ACL12154

SEQ ID NO: 199618 - RNA, 1410 nt, Artificial Sequence; identical to SEQ ID NO: 199536
  derived and/or modified sequence opt5 from neuraminidase__InfluenzaA__ACL12165

SEQ ID NO: 199619 - RNA, 1410 nt, Artificial Sequence; identical to SEQ ID NO: 199536
  derived and/or modified sequence opt5 from neuraminidase__InfluenzaA__ACL12176

SEQ ID NO: 199620 - RNA, 1410 nt, Artificial Sequence
  derived and/or modified sequence opt5 from neuraminidase__InfluenzaA__ACL12198
augaaccccaaucagaagaucauuaccaucggcagcgugucccugacaauuucuacgaucugcuucuuuaugcaaauugccauccucaucaccacagucacccugcacuucaaacaguacgaguuuaacagcacaccuaauaaccagguuaugcuuugugaaccgaccauuaucgagagaaauauuacagaaaucguguaucugaccaacacgaccauugagaaggaaaucugccccaaacucgcugaguaccggaauugguccaagccucagugugacauuacaggguucgcccccuuuucuaaagauaacagcauccgccuguccgcgggaggcgacaucugggugaccagagagccuuaugucucuugcgaucccgacaaguguuaccaauucgcucuugggcagggaacaacccugaauaacgugcauagcaaugauacgguucgggaccgcacaccuuauagaacccuccugaugaacgaacugggcgugccguuucaccucgggacaaagcaggucugcauugccugguccagcagcuccugucaugauggaaaagccuggcugcacgugugcaucaccggcgacgauaagaaugcuaccgccagcuucauuuacaacggccggcuuguugacucuguggucuccuggagcaaagagauccugcgcacacaggaaucugagugugugugcauuaaugggacguguaccguggucaugacagauggauccgcuagcggcaaggccgacaccaaaauccucuuuaucgaggaagggaagauuguucauacauccacccugucuggaagcgcgcaacacguggaggaaugcuccugcuaucccagauacccuggcgugcggugugucugccgcgauaacuggaaggggagcaacagacccaucguggacauuaauaucaaagaccacucuauuguuuccagcuacguguguucuggacuugucggcgauacgccucggaagaacgacagcuccucuagcucccauugccuggaucccaauaacgaggaaggcgggcacggagugaaaggcugggccuucgacgaugggaaugacguuuggaugggacgcacaaucagcgagaagucuagacucggcuaugagaccuuuaaagugaucgaagggugguccaacccgaagucuaaacugcagauuaaucggcaggucaucguggaucgcggaaacagaucuggcuacuccggcauuuucagcgucgaggggaaguccuguaucaaucggugcuuuuauguggaacugauuagaggacgcaaggaggaaaccgagguucucuggacaucuaacagcaucguggucuucuguggcaccuccgggacauacggaacgggcucuuggccugacggggcugauauuaaucugaugcccaucuga

SEQ ID NO: 199621 - RNA, 1410 nt, Artificial Sequence; identical to SEQ ID NO: 199114
  derived and/or modified sequence opt5 from neuraminidase__InfluenzaA__ACL12209

SEQ ID NO: 199622 - RNA, 1410 nt, Artificial Sequence; identical to SEQ ID NO: 199536
  derived and/or modified sequence opt5 from neuraminidase__InfluenzaA__ACL12220

SEQ ID NO: 199623 - RNA, 1410 nt, Artificial Sequence
  derived and/or modified sequence opt5 from neuraminidase__InfluenzaA__ACL12242
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugccuaucuga

SEQ ID NO: 199624 - RNA, 1413 nt, Artificial Sequence
  derived and/or modified sequence opt5 from neuraminidase__InfluenzaA__ACL12264
augaaccccaaucagaagaucauuaccaucggcagcauuuccauggccaucgggauuaucucucugauccuccaaauugugaacaucauuagcaucugggucucccacucuauucagacaggaagccagaaucauacgggcaucugcaaccagagaauuaucaccuacgaaaauuccacauggguuaaccaaaccuaugugaauaucaacaauacaaacguggucgcugggaaagacaagaccucugugacacuggccggaaauagcucccuuuguccuauucggggcugggcgaucuacaccaaagauaacagcauucgcaucgggucuaagggagacguuuucgugauuagagagccguuuaucuccugcagccaccuggagugucggacguucuuucucacccagggcgcucugcuuaaugauaaacauucuaacggcacagucaaggaccgcucccccuauagagcccugaugagcugcccucucggggaagcccccucuccuuacaauucccgguucgagagcguggcuugguccgccucugcuugucacgauggaaugggcuggcugaccaucgggauuagcggacccgacgauggcgccguugcggugcugaaguauaacgggaucauuacagaaaccaucaaauccuggaagaaacgcauucucagaacgcaggagagcgagugcgucugugugaacggaucuugcuuuacaaucaugaccgacggcccuuccaauggcgccgcuagcuaccggaucuucaagauugaaaaagggaaggugacaaagucuaucgagcuggaugccccgaacagccauuaugaagaguguuccugcuaccccgacaccggaaccgucauguguguuugccgcgauaauuggcacggcucuaacagaccuugggugagcuuuaaucagaaccuugacuaccaaauuggguauaucugcuccggaguguucggcgauaauccccggccuaaagacgggaagggaagcugugaccccgucacaguggauggcgcugacggcguuaaaggguuuucuuaccgcuauggaaacggcguguggauugggagaacgaaguccaaucgguuccgcaaaggauuugagaugaucugggauccgaacggcuggaccgacacagauagcgacuucucugucaagcaggaugugguugccaugaccgacugguccggguacagcggcuccuuugugcagcacccugaacugacaggacucgauugcaugagacccuguuucugggucgagcuggugcggggcagaccucgcgaaaauaccacgauuuggacaucugggagcuccaucucuuucugcggagucaacagcgacaccgcgaauugguccuggcccgauggcgccgagcuucccuuuaccaucgacaaauga

SEQ ID NO: 199625 - RNA, 1410 nt, Artificial Sequence; identical to SEQ ID NO: 199429
  derived and/or modified sequence opt5 from neuraminidase__InfluenzaA__ACN32275

SEQ ID NO: 199626 - RNA, 1410 nt, Artificial Sequence
  derived and/or modified sequence opt5 from neuraminidase__InfluenzaA__ACN32286
augaaccccaauaagaaaaucauuaccaucggcagcgugucccugacaauuucuacgaucugcuucuuuaugcagauugccauccucaucaccacagucacccugcacuucaagcaauacgaguuuaacagcccuccgaauaaccagguuaugcuuugugaacccacaauuaucgagagaaauauuaccgaaaucguguaucugacaaacaccacgauugagaaagaaaucugcccuaagcucgcugaguaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaguucgcucuugggcaaggaaccacacugaauaacgugcauagcaaugauaccguucgggaccgcacgccguauagaacacuccugaugaacgaacugggcgugcccuuucaccucgggaccaaacaggucugcauugccugguccucuagcuccugucaugauggaaaggccuggcugcacgugugcaucacaggcgacgauaaaaaugcuaccgccagcuucauuuacaacggccggcuuguugacucuaucguguccuggagcaaggagauucugcgcacccaggaaucugagugugucugcaucaaugggacauguacgguggugaugaccgauggauccgcuagcggcaaagccgacacaaagauccucuuuauugaggaagggaagaucguccauaccuccacacugcuuggaucugcgcagcacguugaggaaugcagcugcuauccuagauaccccggcgugcggugugugugccgcgauaacuggaaaggguccaacagaccuauugucgacaucaauauuaaggaccacagcaucgugucuuccuacguuuguagcggacuggugggcgauacgccccggaaaaacgacucuagcuccucuggccauugccucgauccgaauaacgaggaagggggacacggcgucaaggggugggccuucgacgauggaaaugacguguggaugggccgcaccaucagcgagaaauccagacugggguaugagacauuuaagguuauugaaggauggagcaacccuaaaucuaagcugcaaaucaaucgccaggugauugucgaucggggcaacagauccggcuacagcgggaucuucucuguggagggaaaguccuguauuaaucggugcuuuuaugucgaacucaucagaggccgcaaagaggaaaccgaggugcuguggaccagcaacuccauuguuguguucugugggacaucuggaaccuacggcacagggagcuggcccgacggcgcugauaucaaucuuaugccuaucuga

SEQ ID NO: 199627 - RNA, 1410 nt, Artificial Sequence
  derived and/or modified sequence opt5 from neuraminidase__InfluenzaA__ACN32493
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccaucgugagcuggucuaaagagauucugcgcacccaggaauccgagugugucugcaucaacgggacauguacgguggugaugaccgacggaagcgcuuccggcaaggccgauacaaaaauccucuuuauugaggaagggaagaucguccauaccucuacacugagcggauccgcgcaacacguugaggaaugcagcugcuaucccagauacccuggcgugcggugugugugccgcgacaacuggaaggggucuaauagacccauugucgauaucaacauuaaagaccacuccaucgugagcucuuacguuuguagcggacuugugggcgacaccccucggaagaaugauuccucuagcuccagccauugccuggaccccaacaaugaggaaggcgggcacggagucaaaggcugggccuucgaugacgggaacgauguguggaugggacgcacgaucucugagaaguccagacucggcuaugagacauuuaaaguuauugaaggguggagcaauccgaagucuaaacugcagaucaaccgccaggugauugucgaccggggaaauagauccggcuacagcggcaucuucuccguggaggggaagucuuguauuaaccggugcuuuuaugucgaacugaucagaggacgcaaggaggaaaccgaggugcucuggaccagcaauuccauuguuguguucuguggcacaucugggaccuacggaacaggcagcuggccugauggggcugacaucaaccugaugcccaucuga

SEQ ID NO: 199628 - RNA, 1410 nt, Artificial Sequence; identical to SEQ ID NO: 197178
  derived and/or modified sequence opt5 from neuraminidase__InfluenzaA__ACN32526

SEQ ID NO: 199629 - RNA, 1410 nt, Artificial Sequence
  derived and/or modified sequence opt5 from neuraminidase__InfluenzaA__ACN32537
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccagacaggucuguaucgccuggagcuccagcucuugccacgacggcaaggcuuggcuucauguguguguuacaggcgaugacgagaacgccaccgcuuccuucauuuacaaugggcggcugguggauagcaucggaucuugguccaaaaagauucuccgcacccaggaaagcgagugcgucuguaucaacggcacaugcacgguggugaugaccgacgggucugccuccggaaaagcggauacaaagauucuguuuaucgaggaaggcaaaaucguccacauuagcacccuuuccgggucugcccaacacguugaggaaugcagcuguuauccuagauaccccgacgugcggugcgugugucgcgauaacuggaagggauccaauagaccuaucgucgacauuaacgugaaggacuacagcaucguuucuuccuaugugugcagcggccuggucggcgauacaccccggaaaaaugacucuuucagcuccucucauugucucgauccgaacaaugaggaagggggacacggcgugaaggggugggcuuuugacgauggaaacgacguuuggaugggccgcaccauuagcgagaaacugagauccggguacgagacguucaaggugaucgauggauggagcaaaccuaauucuaagcugcagaucaaccggcaggucauuguggaacgcggcaauagauccggcuauagcgggaucuuuucugucgagggaaaauccugcauuaaccgguguuucuacguggaacucaucagaggccgcaaggaggaaacagagguuugguggaccagcaauuccauuguggucuuuugcgggaccucuggaacauauggcaccgggagcuggcccgacggcgccgauaucaaccugaugccuauuuga

SEQ ID NO: 199630 - RNA, 1413 nt, Artificial Sequence; identical to SEQ ID NO: 199106
  derived and/or modified sequence opt5 from neuraminidase__InfluenzaA__ACN32807

SEQ ID NO: 199631 - RNA, 1413 nt, Artificial Sequence; identical to SEQ ID NO: 199054
  derived and/or modified sequence opt5 from neuraminidase__InfluenzaA__ACN32818

SEQ ID NO: 199632 - RNA, 1413 nt, Artificial Sequence; identical to SEQ ID NO: 199054
  derived and/or modified sequence opt5 from neuraminidase__InfluenzaA__ACN32829

SEQ ID NO: 199633 - RNA, 1413 nt, Artificial Sequence
  derived and/or modified sequence opt5 from neuraminidase__InfluenzaA__ACN32840
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguuguggccggaaaagacaagaccagcgugacacuggcgggcaacuccagccuuuguucuauuuccgggugggcuaucuacaccaaagauaauagcauucggaucggaucuaagggcgacgucuucgugauucgcgaaccuuuuaucuccugcagccaucuggaguguagaacguucuuucucacccaaggcgcccugcuuaacgauaaacacucuaaugggacaguuaaggaccgguccccguaucgcgcccugaugagcugcccccucggagaagcuccuucccccuacaacucuaaguucgagagcguggccugguccgcuagcgccugucaugauggcaugggguggcugaccaucggaauuucuggcccugacaauggggcggucgccgugcugaaauauaacggaaucauuacagaaaccaucaaguccuggaaaaagcggauucucagaacgcaggagagcgagugcguuugugugaacggcucuugcuuuacaaucaugaccgauggccccagcaauggggcugccuccuacaaaaucuucaagauugaaaagggaaaagucacaaagucuaucgagcugaacgcuccuaauuuucacuaugaagaguguagcugcuacccggacaccggcaccgugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacaguggauggcgccgacggggucaaaggauucagcuacaaguauggcaacgggguguggauuggacgcacgaaaucuaauagacugcggaagggcuuugagaugaucugggaccccaacggguggaccgauacagacuccgauuucagcguuaagcaagacguggucgcgauuaccgauugguccggcuacucuggauccuuugugcagcauccggaacucacaggccuggacugcauccgcccuuguuucuggguugagcuugugagagggcugccccgggaaaauaccacgaucuggacauccggaucuagcauuuccuucugcggcgucgauagcgacaccgugaacuggucuuggccugauggggccgagcuccccuuuaccaucgacaaauga

SEQ ID NO: 199634 - RNA, 1410 nt, Artificial Sequence; identical to SEQ ID NO: 199536
  derived and/or modified sequence opt5 from neuraminidase__InfluenzaA__ACN32851

SEQ ID NO: 199635 - RNA, 1410 nt, Artificial Sequence; identical to SEQ ID NO: 199623
  derived and/or modified sequence opt5 from neuraminidase__InfluenzaA__ACN32862

SEQ ID NO: 199636 - RNA, 1410 nt, Artificial Sequence; identical to SEQ ID NO: 199627
  derived and/or modified sequence opt5 from neuraminidase__InfluenzaA__ACN32873

SEQ ID NO: 199637 - RNA, 1410 nt, Artificial Sequence; identical to SEQ ID NO: 199623
  derived and/or modified sequence opt5 from neuraminidase__InfluenzaA__ACN32884

SEQ ID NO: 199638 - RNA, 1410 nt, Artificial Sequence; identical to SEQ ID NO: 199627
  derived and/or modified sequence opt5 from neuraminidase__InfluenzaA__ACN32895

SEQ ID NO: 199639 - RNA, 1410 nt, Artificial Sequence; identical to SEQ ID NO: 199536
  derived and/or modified sequence opt5 from neuraminidase__InfluenzaA__ACN32906

SEQ ID NO: 199640 - RNA, 1410 nt, Artificial Sequence
  derived and/or modified sequence opt5 from neuraminidase__InfluenzaA__ACN32917
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuguaagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaccgaccacucuauuguuuccagcuacguguguucuggacuugucggcgacacgccccggaagaaugauagcuccucuagcucccauugccuggacccgaacaaugaagagggcgggcacggagugaaaggcugggccuucgaugacgggaacgauguuuggaugggacgcacaaucagcgaaaagucuagacucggcuaugagaccuuuaaagugaucgaggggugguccaauccuaagagcaaacugcagauuaaccggcaggucaucguggaccgcggaaauagaucuggcuacuccggcauuuucagcgucgaagggaaguccuguaucaaccggugcuuuuauguggagcugauuagaggacgcaaggaagagaccgaaguucucuggacaucuaauagcaucguggucuucuguggcaccuccgggacauacggaacgggcucuuggcccgauggggcugacauuaaccugaugccuaucuga

SEQ ID NO: 199641 - RNA, 1410 nt, Artificial Sequence
  derived and/or modified sequence opt5 from neuraminidase__InfluenzaA__ACN32928
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaccgaccacucuauuguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcacaaucagcgagaaaucuagacucggcuaugagaccuuuaaggugaucgaagggugguccaauccuaaaagcaagcugcagauuaaccggcaggucaucguggaccgcggaaauagaucuggcuacuccggcauuuucagcgucgaggggaaauccuguaucaaccggugcuuuuauguggaacugauuagaggacgcaaggaggaaaccgagguucucuggacaucuaauagcaucguggucuucuguggcaccuccgggacauacggaacgggcucuuggcccgauggggcugacauuaaccugaugccuaucuga

SEQ ID NO: 199642 - RNA, 1410 nt, Artificial Sequence; identical to SEQ ID NO: 199627
  derived and/or modified sequence opt5 from neuraminidase__InfluenzaA__ACN32939

SEQ ID NO: 199643 - RNA, 1410 nt, Artificial Sequence; identical to SEQ ID NO: 199536
  derived and/or modified sequence opt5 from neuraminidase__InfluenzaA__ACN32950

SEQ ID NO: 199644 - RNA, 1410 nt, Artificial Sequence
  derived and/or modified sequence opt5 from neuraminidase__InfluenzaA__ACN32961
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaccgaccacucuauuguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcacaaucagcgagaaaucuagacucggcuaugagaccuuuaaggugaucgaagggugguccaauccuaaaagcaagcugcagauuaaccggcaggucaucguggaccgcggaaauagaucuggcuacuccggcauuuucagcgucgaggggaaauccuguaucaaccggugcuuuuauguggaacugauuagaggacgcaaggaggaaaccgagguucucuggacaucuaauagcaucguggucuucuguggcaccuccgggacauacggaacgggcucuuggcccgauggggcugacauuaacaucaugccuaucuga

SEQ ID NO: 199645 - RNA, 1410 nt, Artificial Sequence; identical to SEQ ID NO: 199623
  derived and/or modified sequence opt5 from neuraminidase__InfluenzaA__ACN32972

SEQ ID NO: 199646 - RNA, 1410 nt, Artificial Sequence; identical to SEQ ID NO: 199623
  derived and/or modified sequence opt5 from neuraminidase__InfluenzaA__ACN32994

SEQ ID NO: 199647 - RNA, 1410 nt, Artificial Sequence
  derived and/or modified sequence opt5 from neuraminidase__InfluenzaA__ACN33005
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugaucgaagggugguccaacccuaagagcaaacugcagauuaaucggcaggucaucguggaucgcggaaacagaucuggcuacuccggcauuuucagcgucgagggggaauccuguaucaaucggugcuuuuauguggagcugauuagaggacgcaaggaagagaccgagguucucuggaccucuaacagcaucguggucuucuguggcacauccgggaccuacggaacaggcucuuggcccgacggggcugauauuaaucugaugccuaucuga

SEQ ID NO: 199648 - RNA, 1410 nt, Artificial Sequence; identical to SEQ ID NO: 199623
  derived and/or modified sequence opt5 from neuraminidase__InfluenzaA__ACN33016

SEQ ID NO: 199649 - RNA, 1410 nt, Artificial Sequence; identical to SEQ ID NO: 199623
  derived and/or modified sequence opt5 from neuraminidase__InfluenzaA__ACN33049

SEQ ID NO: 199650 - RNA, 1410 nt, Artificial Sequence; identical to SEQ ID NO: 199623
  derived and/or modified sequence opt5 from neuraminidase__InfluenzaA__ACN33060

SEQ ID NO: 199651 - RNA, 1410 nt, Artificial Sequence; identical to SEQ ID NO: 199627
  derived and/or modified sequence opt5 from neuraminidase__InfluenzaA__ACN33082

SEQ ID NO: 199652 - RNA, 1413 nt, Artificial Sequence; identical to SEQ ID NO: 199093
  derived and/or modified sequence opt5 from neuraminidase__InfluenzaA__ACN33093

SEQ ID NO: 199653 - RNA, 1413 nt, Artificial Sequence; identical to SEQ ID NO: 199054
  derived and/or modified sequence opt5 from neuraminidase__InfluenzaA__ACN33104

SEQ ID NO: 199654 - RNA, 1410 nt, Artificial Sequence; identical to SEQ ID NO: 199627
  derived and/or modified sequence opt5 from neuraminidase__InfluenzaA__ACN33115

SEQ ID NO: 199655 - RNA, 1413 nt, Artificial Sequence
  derived and/or modified sequence opt5 from neuraminidase__InfluenzaA__ACN33126
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcagcuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuucauuaugaagaguguagcugcuacccggacaccggcauugucaugugugugugccgggauaauuggcacggguccaaccgccccugggugagcuucaaucagaaccuugacuaccaaaucggauauauuugcucuggcgucuuuggggauaauccuagacccgaggacggagaaggcuccuguaacccuguuaccguggauggcgccaauggggugaaaggauucagcuacaaguaugacaacggcgucuggaucgggcggacaaaaucuaaucgccugagaaagggauuugagaugauuugggaccccaacggcuggacgaauaccgauuccgacuucagcgugaaacaggauguuguggcgaucacagacugguccggguacucuggcagcuuuguccagcacccggaacucaccggacuggauugcauccggccuuguuucuggguggagcuuguucgcggccugcccagagaaaacacaaccauuuggacguccgggucuagcaucuccuucugcggagugaacagcgacacagccaauuggucuuggccugauggcgcugagcuccccuuuaccauugacaaguga

SEQ ID NO: 199656 - RNA, 1413 nt, Artificial Sequence
  derived and/or modified sequence opt5 from neuraminidase__InfluenzaA__ACN33148
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucugacuucuccgugaaacaggauguuguggcgaucacagacuggagcggguacuccggcucuuuuguccagcacccggaacucaccggacuggauugcauccggccuuguuucuggguggagcuuguucgcggccugcccagagaaaacacaaccauuuggacgagcggguccucuaucagcuucugcggagucaauuccgacacagccaacuggagcuggccugauggcgcugagcuccccuuuaccauugacaaguga

SEQ ID NO: 199657 - RNA, 1410 nt, Artificial Sequence
  derived and/or modified sequence opt5 from neuraminidase__InfluenzaA__ACN33159
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaaaugcccuaagcucgcugaguaccggaauugguccaaaccccagugugacaucaccggguucgccccuuuuucuaaggauaacagcauucgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaaacaggucugcaucgccugguccucuagcuccugucaugacggaaaggccuggcugcacgugugcauuacaggcgaugacaaaaacgcuaccgccagcuucaucuacaauggccggcuuguugauucuguggucuccuggagcaaggagauucugcgcacccaggaaucugagugugugugcaucaacgggacauguacgguggucaugaccgacggauccgcuagcggcaaagccgauacaaagauucucuuuaucgaggaagggaagaucguucauaccuccacacugucuggaagcgcgcaacacguggaggaaugcuccugcuauccuagauaccccggcgugcggugugucugccgcgacaacuggaaagggagcaauagaccuauuguggauaucaacauuaaggaccacucuaucguuuccagcuacguguguucuggacuugucggcgacacgccccggaaaaaugauagcuccucuagcucccauugccuggacccgaacaaugaggaaggcgggcacggagugaagggcugggccuucgaugacgggaacgauguuuggaugggacgcaccauuagcgagaaaucuagacucggcuaugagacauuuaaggugaucgaagggugguccaauccuaaaagcaagcugcagaucaaccggcaggucauuguggaccgcggaaauagaucuggcuacuccggcaucuucagcgucgaggggaaguccuguauuaaccggugcuuuuauguggaacugaucagaggacgcaaagaggaaaccgagguucucuggaccucuaauagcauuguggucuucuguggcacauccgggaccuacggaacaggcucuuggcccgauggggcugacaucaaccugaugccuauuuga

SEQ ID NO: 199658 - RNA, 1410 nt, Artificial Sequence; identical to SEQ ID NO: 199536
  derived and/or modified sequence opt5 from neuraminidase__InfluenzaA__ACN33170

SEQ ID NO: 199659 - RNA, 1410 nt, Artificial Sequence; identical to SEQ ID NO: 199627
  derived and/or modified sequence opt5 from neuraminidase__InfluenzaA__ACN33181

SEQ ID NO: 199660 - RNA, 1410 nt, Artificial Sequence; identical to SEQ ID NO: 199627
  derived and/or modified sequence opt5 from neuraminidase__InfluenzaA__ACN33203

SEQ ID NO: 199661 - RNA, 1410 nt, Artificial Sequence
  derived and/or modified sequence opt5 from neuraminidase__InfluenzaA__ACN33214
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaacaguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcaaggccgauaccaaaauucucuuuaucgaggaagggaagaucguucauacauccacccugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuagcgagaagucuagacucggcuaugagaccuuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggacaucuaauagcauuguggucuucuguggcaccuccgggacauacggaacgggcucuuggcccgauggggcugacaucaaccugaugccuauuuga

SEQ ID NO: 199662 - RNA, 1413 nt, Artificial Sequence; identical to SEQ ID NO: 199095
  derived and/or modified sequence opt5 from neuraminidase__InfluenzaA__ACN42984

SEQ ID NO: 199663 - RNA, 1413 nt, Artificial Sequence; identical to SEQ ID NO: 199095
  derived and/or modified sequence opt5 from neuraminidase__InfluenzaA__ACN42995

SEQ ID NO: 199664 - RNA, 1410 nt, Artificial Sequence
  derived and/or modified sequence opt5 from neuraminidase__InfluenzaA__ACN43006
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaacagaguuaugcuuugugaacccacaauuaucgagcggaauauuaccgaaaucguguaucugacaaacaccacgauugagaaggaaaucugcccuaaacucgcugaguaccgcaauugguccaagccccagugugacauuaccggguucgccccuuuuucuaaagauaacagcaucagacuguccgcgggaggcgacaucugggugacacgggagcccuaugucucuugcgauccugacaaguguuaccaguucgcucuugggcaaggaaccacacugaauaacgugcauagcaauaacaccguucgcgauagaacgccguaucggacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccgccuuguugauucuguggucuccuggagcaaagagauccugagaacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcagcacguggaggaaugcuccugcuauccucgguaccccggcgugcgcugugucugcagagacaacuggaaggggagcaaucggccuaucguggauauuaacaucaaagaccacucuauuguuuccagcuacguguguucuggacuugucggcgacacgccccgcaagaaugauagcuccucuagcucccauugccuggacccgaacaaugaggaaggcgggcacggagugaaaggcugggccuucgaugacgggaacgauguuuggaugggaagaaccaucagcgagaagucucggcucggcuaugagacauuuaaagugaucgaagggugguccaauccuaagagcaaacugcaaauuaaccgccaggucaucguggacagaggaaaucggucuggcuacuccggcauuuucagcgucgaggggaaguccuguaucaacagaugcuuuuauguggaacugauucgcggacggaaggaggaaaccgagguucucuggaccucuaauagcaucguggucuucuguggcacauccgggaccuacggaacaggcucuuggcccgauggggcugacauuaaccugaugccuaucuga

SEQ ID NO: 199665 - RNA, 1410 nt, Artificial Sequence; identical to SEQ ID NO: 199627
  derived and/or modified sequence opt5 from neuraminidase__InfluenzaA__ACN43017

SEQ ID NO: 199666 - RNA, 1410 nt, Artificial Sequence; identical to SEQ ID NO: 199623
  derived and/or modified sequence opt5 from neuraminidase__InfluenzaA__ACN43028

SEQ ID NO: 199667 - RNA, 1410 nt, Artificial Sequence
  derived and/or modified sequence opt5 from neuraminidase__InfluenzaA__ACN43039
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgagaccaagcaggucugcauugccugguccucuagcuccugucaugaugggaaagccuggcugcacgugugcaucacaggagacgauaagaaugcuaccgccagcuucauuuacaacggccggcuuguugacucuguggucuccuggagcaaagaaauccugcgcacccaggagucugagugugugugcauuaauggcacauguacgguggucaugaccgauggguccgcuagcggaaaggccgacacaaaaauccucuuuaucgaagagggcaagauuguucauaccuccacacugucugggagcgcgcaacacguggaagagugcuccugcuauccuagauaccccggagugcggugugucugccgcgauaacuggaagggcagcaacagaccuaucguggacauuaauaucaaagaccacucuauuguuuccagcuacguguguucugggcuugucggagauacgccccggaagaacgacagcuccucuagcucccauugccuggauccgaauaacgaagagggcggccacggggugaaaggaugggccuucgacgauggcaaugacguuuggauggggcgcaccaucagcgagaagucuagacucggauaugaaacauuuaaagugaucgagggcugguccaacccuaagagcaaacugcagauuaaucggcaggucaucguggaucgcgggaacagaucuggauacuccggcauuuucagcgucgaaggcaaguccuguaucaaucggugcuuuuauguggagcugauuagagggcgcaaggaagagaccgagguucucuggaccucuaacagcaucguggucuucuguggaacauccggcaccuacgggacaggaucuuggcccgacggcgcugauauuaaucugaugccuaucuga

SEQ ID NO: 199668 - RNA, 1410 nt, Artificial Sequence; identical to SEQ ID NO: 199536
  derived and/or modified sequence opt5 from neuraminidase__InfluenzaA__ACN43050

SEQ ID NO: 199669 - RNA, 1410 nt, Artificial Sequence; identical to SEQ ID NO: 199623
  derived and/or modified sequence opt5 from neuraminidase__InfluenzaA__ACN43061

SEQ ID NO: 199670 - RNA, 1410 nt, Artificial Sequence
  derived and/or modified sequence opt5 from neuraminidase__InfluenzaA__ACN43072
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcguggucguguucuguggcacauccgggaccuacggaacaggcucuuggcccgauggggcugacaucaaccugaugccuauuuga

SEQ ID NO: 199671 - RNA, 1410 nt, Artificial Sequence
  derived and/or modified sequence opt5 from neuraminidase__InfluenzaA__ACN43083
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccaucgugagcuggucuaacgagauucugcgcacccaggaauccgagugugucugcaucaacgggacauguacgguggugaugaccgacggaagcgcuuccggcaaagccgauacaaagauccucuuuauugaggaagggaaaaucguccauaccucuacacugagcggauccgcgcaacacguugaggaaugcagcugcuaucccagauacccuggcgugcggugugugugccgcgacaauuggaaggggucuaacagacccauugucgauaucaauauuaaggaccacuccaucgugagcucuuacguuuguagcggacuugugggcgacaccccucggaaaaacgauuccucuagcuccagccauugccuggaccccaauaacgaggaaggcgggcacggagucaagggcugggccuucgaugacgggaaugauguguggaugggacgcacgaucucugagaaauccagacucggcuaugagacauuuaagguuauugaaggguggagcaacccgaaaucuaagcugcagaucaaucgccaggugauugucgaccggggaaacagauccggcuacagcggcaucuucuccguggaggggaaaucuuguauuaaucggugcuuuuaugucgaacugaucagaggacgcaaggaggaaaccgaggugcucuggaccagcaacuccauuguuguguucuguggcacaucugggaccuacggaacaggcagcuggccugauggggcugacaucaaucugaugcccaucuga

SEQ ID NO: 199672 - RNA, 1410 nt, Artificial Sequence; identical to SEQ ID NO: 197351
  derived and/or modified sequence opt5 from neuraminidase__InfluenzaA__ACN50231

SEQ ID NO: 199673 - RNA, 1410 nt, Artificial Sequence
  derived and/or modified sequence opt5 from neuraminidase__InfluenzaA__ACN50233
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacggugguccucaccgauggauccgcuagcggcaaggccgacacaaaaauccuguuuaucgaggaagggaagauuguucacaccuccaaacuuucuggaagcgcgcaacacguggaggaaugcuccugcuauccucgcuaccccggcgugagaugugucugccgggauaacuggaaagggagcaaccgcccuaucguggacauuaauaucaaggacuacucuauuguuuccagcuauguguguucuggacuggucggcgauacacccagaaagaacgacagcuccucuagcggccauugccucgauccgaauaacgaggaagggggacacggcgugaaggggugggccuucgacgauggaaaugacguuuggaugggccggaccaucuccgagaaacugcgcagcggguacgagacguuuaaggugaucgaaggauggucuaacccuaauuccaaacugcagauuaacagacaggucaucguggaucggggcaaucgcagcggcuauucugggauuuucuccgucgagggaaagagcuguaucaacagaugcuuuuacguggaacucauucggggcagaaaggaggaaacagagguucuguggaccuccaauucuaucguggucuucugugggaccagcggaacauauggcaccggguccuggcccgacggcgcugauauuaaccuuaugccuaucuga

SEQ ID NO: 199674 - RNA, 1410 nt, Artificial Sequence
  derived and/or modified sequence opt5 from neuraminidase__InfluenzaA__ACN50245
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguugugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggucacaagagagcccuaugugucuugcgauccugacaaguguuaccaauucgcucuugggcagggaaccacacugaauaacguucauagcaaugauaccgugcgggaccgcacgccguauagaacacuccugaugaacgaacugggcguccccuuucaccucgggaccaaacaggugugcauugccugguccucuagcuccugucaugauggaaaggccuggcugcacguuugcaucacaggcgacgauaagaaugcuaccgccagcuucauuuacaacggccggcuuguggacucuaucgucuccuggagcaaagagauucugcgcacccaggaaucugagugugugugcaucaaugggacauguacgguggucaugaccgauggauccgcuagcggcaaggccgacacaaaaauccucuuuauugaggaagggaagaucguucauaccuccacacugucuggaagcgcgcaacacguggaggaaugcuccugcuauccuagauaccccggcgugcggugugucugccgcgauaacuggaaggggagcaacagaccuauuguggacaucaauauuaaagaccacucuaucguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacauuuaaagugauugaagggugguccaacccuaagagcaaacugcagaucaaucggcaggucauuguggaucgcggagacagaucuggcuacuccggcaucuucagcgucgaggggaaguccuguauuaaccggugcuuuuauguggaacugaucagaggacgcaaggaggaaaccgagguucucuggaccucuaauagcauuguggucuucuguggcacauccgggaccuacggaacaggcucuuggcccgauggggcugacaucaaccugaugccuaucuga

SEQ ID NO: 199675 - RNA, 1413 nt, Artificial Sequence
  derived and/or modified sequence opt5 from neuraminidase__InfluenzaA__ACN72609
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuacaaaaucggauauauuugcagcggcgucuuuggggauaacccuagacccgaggacggagaaggcucuuguaauccuguuaccguggauggcgccaacggggugaagggauucuccuacaaauaugacaauggcgucuggaucgggcggacaaagagcaaccgccugagaaaaggauuugagaugauuugggaccccaauggcuggacgaacaccgauucugacuucuccgugaagcaagauguuguggcgaucacagacuggagcggguacuccggcucuuuuguccagcacccggaacucaccggacuggauugcauccggccuuguuucuggguggagcuuguucgcggccugcccagagaaaacacaaccauuuggacgagcggguccucuaucagcuucugcggagucaauuccgacacagccaacuggagcuggccugauggcgcugagcuccccuuuaccauugacaaguga

SEQ ID NO: 199676 - RNA, 1410 nt, Artificial Sequence
  derived and/or modified sequence opt5 from neuraminidase__InfluenzaA__ACN72621
augaaccccaaucagaagaucauuaucauuagcuccaucugcaugaccaacggcauugccucucugauccuccaaaucgggaauauuaucagcauuuggaucucccacucuauucagacaggaaaccagaaucagacggagaccuguaaccaaagcgugaucauuuacgaaaauaacacaugggucaaucagaccuauguuaacaucuccaauaacaauuucguggcugagcagacaguggucccugugaaacugguuggcucuagcccgcuuugccccguguccgggugggccaucuacagcaaggacaacucugucagaauuggauccaaaggcgauguguuuguuauccgggaaccuuucauuagcuguucucaucuggagugccgcaccuuuuuccucacacagggggcgcugcuuaaugacaagcacuccaacggaaccgugaaagauagaagccccuaucggacgcugaugucuuguccuaucggcgaaguccccuccccuuacaacagccgcuuugaguccguggcuuggucugccagcgccugccaugacggcuccagcuggcucaccauugggaucucuggaccggauaauggcgcuguggccguccugaaguauaacgacaucauuacagauaccaucaaguccuggaaaaauaacauucugagaacacaagagagcgaaugugcuugccucaaugggucuuguuucaccguuaugacggacggacccagcaacggccaggccuccuacaagaucuuuaaaauugagaaggggaaaguggugaagucugucgaacugaaugcgccuaacuaucacuacgaggagugcagcuguuaccccgauuccggagaaaucaucugcgugugccgggacaauuggcauggcagcaaccgcccuuggguuucuuucaaucagaaccuugaguaucagauuggcuacaucuguuccggggugcugggagauaaucccagaccgaacgaccggacaggcaauugcgggccugucagcucucacggagccaacggcgugaagggguuuuccuucaaauauggagauggcauuuggaucggccgcaccaagagcacauccucuagaagcggguuugaaaugauuugggaccccaacggauggaccggcaccgacaauaacuucuccguuaaacaagauaucguggggauuacagacuggacgggauacucuggcagcuuuguccagcacccugagcucaccgggcuggauuguauccggcccugcuucuggguggaacuuauccgcggcagacccaaggagaauacaauuuggaccuccggaagcucuaucuccuucuguggcgucaacagcgacacagugggguggucuuggccugauggagcugagcugccguuuaccauugacaaauga

SEQ ID NO: 199677 - RNA, 1410 nt, Artificial Sequence; identical to SEQ ID NO: 199536
  derived and/or modified sequence opt5 from neuraminidase__InfluenzaA__ACN76503

SEQ ID NO: 199678 - RNA, 1410 nt, Artificial Sequence
  derived and/or modified sequence opt5 from neuraminidase__InfluenzaA__ACO36345
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcagugugaaccgacaauuaucgagagaaauauuaccgaaaucguguaucuuacaaacaccacgauugagaaggaaaucugccccaaacuggcugaguaccggaauuggucuaagccucaaugugacauuaccggguucgcccccuuuagcaaagauaacuccauccgccucucugcgggaggcgacaucugggugacaagagagccuuaugucagcugcgaucccgacaaguguuaccaguucgcucuggggcagggaaccacacuuaauaacgugcauuccaauaacaccguucgggaucgcacgccuuauagaacacugcucaugaaugaacugggcgugccguuucaccuggggaccaagcaggucugcauugccuggucuagcuccagcugucaugacggaaaagccuggcuccacgugugcaucacaggcgaugacaagaacgcuaccgccucuuucauuuacaauggccggcugguugauuccaucgugagcuggucuaaagagauucuucgcacccaagaauccgagugugucugcaucaacgggacauguacgguggugaugaccgacggaagcgcuuccggcaaggccgauacaaaaauccuguuuauugaggaagggaagaucguccauaccucuacacucagcggauccgcgcagcacguugaggaaugcagcugcuaucccagauacccuggcgugcggugugugugccgcgacaacuggaaggggucuaauagacccauugucgauaucaacauuaaagaccacuccaucgugagcucuuacguuuguagcggacuggugggcgacaccccucggaagaaugauuccucuagcuccagccauugccuugaccccaacaaugaggaaggcgggcacggagucaaaggcugggccuucgaugacgggaacgauguguggaugggacgcacgaucucugagaaguccagacugggcuaugagacauuuaaaguuauugaaggguggagcaauccgaagucuaaacuccagaucaaccgccaggugauugucgaccggggaaauagauccggcuacagcggcaucuucuccguggaggggaagucuuguauuaaccggugcuuuuaugucgaacugaucagaggacgcaaggaggaaaccgaggugcuguggaccagcaauuccauuguuguguucuguggcacaucugggaccuacggaacaggcagcuggccugauggggcugacaucaaccucaugcccaucuga

SEQ ID NO: 199679 - RNA, 1410 nt, Artificial Sequence; identical to SEQ ID NO: 198004
  derived and/or modified sequence opt5 from neuraminidase__InfluenzaA__ACO36356

SEQ ID NO: 199680 - RNA, 1410 nt, Artificial Sequence
  derived and/or modified sequence opt5 from neuraminidase__InfluenzaA__ACO36367
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggaaccgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuaucguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacugaucagaggacgcaaggaggaaaccgaggugcucuggaccucuaauagcauuguuguguucuguggcacauccgggaccuucggaacaggcucuuggcccgauggggcugacaucaaccugaugccuaucuga

SEQ ID NO: 199681 - RNA, 1413 nt, Artificial Sequence; identical to SEQ ID NO: 199656
  derived and/or modified sequence opt5 from neuraminidase__InfluenzaA__ACO36400

SEQ ID NO: 199682 - RNA, 1410 nt, Artificial Sequence
  derived and/or modified sequence opt5 from neuraminidase__InfluenzaA__ACO36411
augaaccccaaucagaagaucauuaccaucggcagcgugucccugacaauuucuacgaucggguucuuuaugcaaaccgccauucucaucacaaccgucacacugcacuucaaacaguacgaguuuaacagcccuccgaauaaccagguuaugcuuugcgaacccaccaucauugagagaaauaucacagaaauuguguaucugaccaacacgaccaucgagaaggaaauuuguccuaaacucgcugaguaccggaauugguccaagccccagugcgacaucacaggauucgccccuuuuucuaaagauaacagcauucgccuguccgcgggcggggacaucugggugaccagagagcccuaugucucuugugauccugacaagugcuaccaauucgcucuuggacagggcacaacccugaauaacgugcauagcaaugauacgguucgggggcgcacaccguauagaacccuccugaugaacgaacugggagugcccuuucaccucggcacaaagcaggucuguaucgccugguccucuagcuccugccaugacggcaaagccuggcugcacguguguauuaccggggaugacaagaaugcuaccgccagcuucaucuacaacggacggcuuguugauucuauuguguccuggagcaaagagauccugcgcacacaggaaucugagugcgucuguauuaauggcacgugcaccguggugaugacagacggguccgcuagcggaaaggccgauaccaaaauccucuuuaucgaggaaggcaagauuguccauacauccacccugucugggagcgcgcaacacguugaggaauguuccugcuauccuagauaccccggagugcggugcgugugucgcgacaacuggaagggcagcaacagaccuaucgucgauauuaauaucaaagaccacucuauuguguccagcuacguuugcucuggccuugugggggacacgccccggaagaacgauagcuccucuagcucccauugucuggacccgaauaacgaggaaggaggccacggggucaaaggaugggccuucgaugacggcaaugauguguggauggggcgcacaaucagcgagaagucuagacucggauaugagaccuuuaaaguuaucgaaggcugguccaacccuaagagcaaacugcagauuaaucgccaggugaucgucgaccggggcaacagaucuggguacuccggaauuuucagcguggagggcaaguccugcaucaaucgguguuuuuaugucgaacugauuagagggcgcaaggaggaaaccgaggugcucuggacaucuaacagcaucguuguguucugcggaaccuccggcacauacgggacgggcucuuggcccgauggagcugacauuaaucugaugccuaucuga

SEQ ID NO: 199683 - RNA, 1410 nt, Artificial Sequence
  derived and/or modified sequence opt5 from neuraminidase__InfluenzaA__ACO36422
augaaccccaaucagaagaucauuaccaucggcagcgugucccugauuaucucuacaauuugcuucuuuaugcaaacggccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucggggccgcacgccguauagaacacuccugaugaacgaacugggggugcccuuucaccucggaaccaagcaggucugcauugccugguccucuagcuccugucaugacggcaaagccuggcugcacgugugcaucacaggcgaugacaagaaugcuaccgccagcuucauuuacaacgggcggcuuguugauucuaucguguccuggagcaaagagauucugcgcacccaggaaucugagugugucugcaucaauggaacauguacgguggugaugaccgacggcuccgcuagcgggaaggccgauacaaaaauccucuuuauugaggaaggaaagaucguccauaccuccacacugucuggcagcgcgcaacacguugaggaaugcuccugcuauccuagauaccccggggugcggugugugugccgcgacaacuggaagggaagcaacagaccuauugucgauaucaauauuaaagaccacucuaucguguccagcuacguuuguucuggccuugugggcgacacgccccggaagaacgauagcuccucuagcucccauugccuggacccgaauaacgaggaagggggacacggcgucaaagggugggccuucgaugacggaaaugauguguggaugggccgcaccaucagcgagaagucuagacucggguaugagacauuuaaaguuauugaaggaugguccaacccuaagagcaaacugcagaucaaucgccaggugauugucgaccggggcaacagaucuggcuacuccgggaucuucagcguggagggaaaguccuguauuaaucggugcuuuuaugucgaacugaucagaggccgcaaggaggaaaccgaggugcucuggaccucuaacagcauuguuguguucugugggacauccggaaccuacggcacagggucuuggcccgauggcgcugacaucaaucugaugccuaucuga

SEQ ID NO: 199684 - RNA, 1410 nt, Artificial Sequence; identical to SEQ ID NO: 199440
  derived and/or modified sequence opt5 from neuraminidase__InfluenzaA__ACO36433

SEQ ID NO: 199685 - RNA, 1410 nt, Artificial Sequence
  derived and/or modified sequence opt5 from neuraminidase__InfluenzaA__ACO36444
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaaaauguccuaagcuggccgaguaucggaauuggagcaaaccccagugcaacauuaccggguucgcgccuuuuuccaaggacaauucuauccgccuuagcgcuggaggcgauauuugggucacaagagagcccuacguguccugugacccugauaagugcuaucaauucgcccuggggcagggaaccacacucaacaauggccacucuaacaauaccguucaugaccggacgccguaccgcacacugcugaugaacgaacucggggugcccuuucaccugggaaccagacaggucuguaucgccuggagcuccagcucuugccaugauggcaaggcuuggcuucacguguguguuacaggcgacgauaaaaaugccaccgcuuccuucaucuauaacgggcggcugguggacagcauuggaucuugguccaaaaagauccuccgcacccaggagagcgaaugcgucuguauuaacggcacaugcacgguggugaugaccgaugggucugccuccgagaaagcggacacaaagauccuguuuauugaggaaggaaagaucguccacaucagcacccuuuccggcucugcccaacauguugaggaaugcagcuguuacccuagauaucccggggugcggugcgugugucgcgauaauuggaaaggauccaacagaccuauugucgacaucaaugugaaggauuacagcauuguuucuuccuacgugugcagcggccuggucggcgacacaccccggaaaaacgacucuuucagcuccucucacugucucgauccgaauaacgaggaagggggacauggcgugaaggggugggcuuuugacgauggaaaugacguuuggaugggccgcaccaucagcgagaaacugagauccggguaugagacguucaaggugauugaaggauggagcaaaccuaacucuaagcugcagaucaaucggcaggucaucguggagcgcggcaacagauccggcuacagcgggaucuuuucugucgaaggaaaguccugcauuaaucgguguuucuauguggagcucauuagaggccgcaaagaagagacagagguuugguggaccagcaacuccaucguggucuuuugcgggaccucuggaacauacggcaccgggagcuggcccgauggcgccgacauuaaucugaugccuaucuga

SEQ ID NO: 199686 - RNA, 1410 nt, Artificial Sequence
  derived and/or modified sequence opt5 from neuraminidase__InfluenzaA__ACO36466
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucgcuuaucugacaaacaccacgauugagaaggaaaucugcccuaaacucgccgaguaccggaauugguccaagccccaguguaacauuaccggguucgcgccuuuuucuaaagacaauagcauccgccuguccgcuggaggcgauaucugggugacaagagagcccuaugugucuugcgacccugauaaguguuaccaauucgcccuugggcagggaaccacacugaacaauguccauagcaacgacaccgugcacgaucggacgccguaucgcacacuccugaugaaugaacugggcguucccuuucaucucgggaccaaacaggugugcauugccugguccucuagcuccugucacgacggaaaggcuuggcugcaugucugcgugacaggcgaugacgagaacgccaccgcuagcuucaucuacaauggcagacuuguugauucuguggucuccuggagcaagaaaauucugcggacccaggaaucugagugugugugcaucaacgggacauguacgguggucaugaccgacggauccgccagcggcaaggcggauacaaaaauucucuuuaucgaggaagggaagaucguucacaccuccacacugucuggaagcgcccaacacguggaggaaugcuccugcuauccucgcuaccccggcgugagaugugucugccgggacaacuggaaggggagcaaucgcccuauuguggauaucaacauuaaagacuacucuaucguuuccagcuauguguguucuggacuugucggcgacacccccagaaagaaugauagcuccucuagcucccauugccuggacccgaacaaugaggaaggcgggcacggagugaaaggcugggcuuucgaugacgggaacgauguuuggaugggacggacgauuagcgagaagcuccgcucuggcuacgagacauuuaaagugaucgaagggugguccaauccuaacagcaagcugcagaucaauagacaggucauuguggaccggggaaaccgcucuggcuauuccggcaucuucagcgucgaggggaaauccuguauuaauagaugcuuuuacguggaacugauccggggaagaaaccaggagaccgaaguucucuggaccucuaauagcauuguggucuucuguggcacauccgggaccuauggaacaggcucuuggcccgauggggccgacaucaaccugaugccuauuuga

SEQ ID NO: 199687 - RNA, 1410 nt, Artificial Sequence
  derived and/or modified sequence opt5 from neuraminidase__InfluenzaA__ACO36477
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauuuguccuaaacuggccgaguaucggaauuggagcaagccccagugcaacaucaccggguucgcgccuuuuuccaaagacaauucuauucgccuuagcgcuggaggcgauaucugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucauuuauaaugggcggcugguggauagcaucggaucuugguccaagaacauucuccgcacccaggagagcgaaugcgucuguaucaacggcacaugcacgguggugaugaccgacgggucugccuccggaaaagcggauacaaagauucuguuuaucgaggagggcaaaaucguccacauuagcacccuuuccgggucugcccaacauguugaagagugcagcuguuacccuagauaucccggagugcggugcgugugucgcgacaauuggaagggcuccaacagaccuaucgucgauauuaaugugaaggacuacagcaucguuucuuccuacgugugcagcggccuggucggggacacaccccggaaaaacgauucuuucagcuccucucacugucucgacccgaauaacgaagagggaggccauggggugaagggaugggcuuuugaugacggcaaugauguuuggauggggcgcaccauuagcgaaaaacugagauccggauaugagacguucaaggugaucgagggcuggagcaaaccuaacucuaagcugcagaucaaucggcaggucauuguggaacgcggcaacagauccggguacagcggaaucuuuucugucgagggcaaauccugcauuaaucgguguuucuauguggaacucaucagagggcgcaaggaggaaacagagguuugguggaccagcaacuccauuguggucuuuugcggaaccucuggcacauacgggaccggcagcuggcccgacggagccgauaucaaucugaugccuauuuga

SEQ ID NO: 199688 - RNA, 1410 nt, Artificial Sequence
  derived and/or modified sequence opt5 from neuraminidase__InfluenzaA__ACO36499
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucugucguguccuggagcaaaaagauucugcggacccaggagucugaaugugugugcaucaacgggacauguacggucguuaugaccgacggauccgcuagcggcaaagccgauacaaagauucucuuuaucgaggaggggaagaucgugcacaccuccacacugucuggaagcgcgcaacacguggaagagugcuccugcuauccucgcuaccccggcgucagaugugugugccgggacaacuggaaagggagcaaucgcccuauuguugauaucaacauuaaggacuacucuaucguguccagcuaugucuguucuggacuugugggcgacacccccagaaagaaugauagcuccucuagcucccauugccuggacccgaacaaugaagagggcgggcacggaguuaaaggcugggccuucgaugacgggaacgauguguggaugggacggacgauuagcgaaaaacuccgcucuggcuacgagacauuuaaggucaucgaggggugguccaauccuaacagcaaacugcagaucaauagacaggugauugucgaccggggaaaccgcucuggcuauuccggcaucuucagcguggaagggaaguccuguauuaauagaugcuuuuacguugagcugauccggggaagaaaccaggaaaccgaggugcucuggaccucuaauagcauugucguguucuguggcacauccgggaccuauggaacaggcucuuggcccgauggggcugacaucaaccugaugccuauuuga

SEQ ID NO: 199689 - RNA, 1410 nt, Artificial Sequence; identical to SEQ ID NO: 197351
  derived and/or modified sequence opt5 from neuraminidase__InfluenzaA__ACO36510

SEQ ID NO: 199690 - RNA, 1410 nt, Artificial Sequence; identical to SEQ ID NO: 197351
  derived and/or modified sequence opt5 from neuraminidase__InfluenzaA__ACO36543

SEQ ID NO: 199691 - RNA, 1410 nt, Artificial Sequence; identical to SEQ ID NO: 197351
  derived and/or modified sequence opt5 from neuraminidase__InfluenzaA__ACO36554

SEQ ID NO: 199692 - RNA, 1410 nt, Artificial Sequence; identical to SEQ ID NO: 197351
  derived and/or modified sequence opt5 from neuraminidase__InfluenzaA__ACO36565

SEQ ID NO: 199693 - RNA, 1410 nt, Artificial Sequence
  derived and/or modified sequence opt5 from neuraminidase__InfluenzaA__ACO36576
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaacuggaaggggagcaaccgcccuaucguggacauuaauaucaaagacuacucuauuguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucgugggacggggcaaucgcucuggcuauuccgggauuuucagcgucgagggaaaauccuguaucaacagaugcuuuuacguggaacugauucggggcagaaaggaggaaaccgagguucucuggaccucuaauagcaucguggucuucugugggacauccggaaccuauggcacagggucuuggcccgauggcgcugacauuaaccugaugccuaucuga

SEQ ID NO: 199694 - RNA, 1410 nt, Artificial Sequence; identical to SEQ ID NO: 197351
  derived and/or modified sequence opt5 from neuraminidase__InfluenzaA__ACO36587

SEQ ID NO: 199695 - RNA, 1410 nt, Artificial Sequence; identical to SEQ ID NO: 197736
  derived and/or modified sequence opt5 from neuraminidase__InfluenzaA__ACO36609

SEQ ID NO: 199696 - RNA, 1410 nt, Artificial Sequence
  derived and/or modified sequence opt5 from neuraminidase__InfluenzaA__ACO36620
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcaggucaauagacaggugauugucgaccggggaaaccgcucuggcuauuccggcaucuucagcguggaggggaaauccuguauuaauagaugcuuuuacguugaacugauccggggaagaaaggaggaaaccgaggugcucuggaccucuaacagcauugucguguucuguggcacauccgggaccuauggaacaggcucuuggcccgauggggcugacaucaaucugaugccuauuuga

SEQ ID NO: 199697 - RNA, 1410 nt, Artificial Sequence; identical to SEQ ID NO: 197736
  derived and/or modified sequence opt5 from neuraminidase__InfluenzaA__ACO36631

SEQ ID NO: 199698 - RNA, 1410 nt, Artificial Sequence; identical to SEQ ID NO: 197736
  derived and/or modified sequence opt5 from neuraminidase__InfluenzaA__ACO36653

SEQ ID NO: 199699 - RNA, 1410 nt, Artificial Sequence
  derived and/or modified sequence opt5 from neuraminidase__InfluenzaA__ACO36675
augaaccccaaucagaagaucauuaccaucggcagcgugucccugacaauuucuacgaucugccucuucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccaguguaacauuaccggguuugccccuuucucuaaagacaauagcauccgccuuuccgcgggaggcgauaucugggugacaagagagcccuaugucucuugcgacccugauaaguguuaccaauuugcucuggggcagggaaccacacucaacaaugugcauagcaacgacaccguucacgaucggacgccguaucgcacacugcugaugaaugaacucggcgugcccuuccaucuggggaccaagcaggucugcauugccugguccucuagcuccugucacgacggaaaagccuggcuucaugugugcguuacaggcgaugacaagaacgcuaccgccagcuuuaucuacaauggcagacugguggauucuauugucuccuggagcaaagagauccuccggacccaggaaucugagugugugugcauuaacgggacauguacgguggucaugaccgacggauccgcuagcggcaaggccgauacaaaaauccuguucaucgaggaagggaagauuguucacaccuccacacuuucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuggucggcgacacccccagaaagaaugauagcuccucuagcucccauugccucgacccgaacaaugaggaaggcgggcacggagugaaaggcugggccuuugaugacgggaacgauguuuggaugggacggacgaucagcgagaagcugcgcucuggcuacgagacauucaaagugaucgaagggugguccaauccuaacagcaagcugcagauuaauagacaggucaucguggaccggggaaaccgcucuggcuauuccggcauuuuuagcgucgaggggaaauccuguaucaauagaugcuucuacguggaacucauucggggaagaaaggaggaaaccgagguucuguggaccucuaacagcaucguggucuuuuguggcacauccgggaccuauggaacaggcucuuggcccgauggggcugacauuaaucuuaugccuaucuga

SEQ ID NO: 199700 - RNA, 1410 nt, Artificial Sequence
  derived and/or modified sequence opt5 from neuraminidase__InfluenzaA__ACO36686
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgaccaugauaaguguuaccaauucgcucuugggcagggaaccacacugaacaaugugcacagcaacgacaccguucaugaucggacgccuuaucgcacacuccugaugaaugaacugggcgugccguuucaccucgggaccaagcaggucugcauugccugguccucuagcuccugucaugacggaaaagccuggcugcacgugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacauguggaggaaugcuccugcuauccccgcuacccuggcgugagaugugucugccgggacaacuggaaggggagcaaucgccccaucguggauauuaacaucaaagacuacucuauuguuuccagcuauguguguucuggacuugucggcgacaccccuagaaagaaugauagcuccucuagcucccacugccuggaccccaacaaugaggaaggcgggcauggagugaaaggcugggccuucgaugacgggaacgauguuuggaugggacggacgaucagcgagaagcuccgcucuggcuacgagacauuuaaagugaucgaagggugguccaauccgaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggccugauggggcugacauuaaucugaugcccaucuga

SEQ ID NO: 199701 - RNA, 1410 nt, Artificial Sequence
  derived and/or modified sequence opt5 from neuraminidase__InfluenzaA__ACO37125
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcaugcuuguggacucuauugucuccuggagcaaagagauccugagaacccaggaaucugagugugugugcauuaaugggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgguaccccggcgugcgcugugucugcagagauaacuggaaggggagcaaccggccuaucguggacauuaauaucaaagacuacucuauuguuuccagcuauguguguucuggacuugucggcgauacgccccgcaagaacgacagcuccucuagcucccauugccuggauccgaauaacgaggaaggcgggcacggagugaaaggcugggccuucgacgaugggaaugacguuuggaugggaagaaccaucagcgagaagcuccggucuggcuacgagacauuuaaagugaucgaagggugguccaacccuaauagcaagcugcagauuaaccgccaggucaucguggauagaggaaaucggucuggcuauuccggcauuuucagcgucgaggggaaauccuguaucaaccgcugcuuuuacguggaacugauuagaggacggaaggaggaaaccgagguucucuggaccucuaauagcaucguggucuucuguggcacauccgggaccuauggaacaggcucuuggcccgacggggcugauauuaaccugaugccuaucuga

SEQ ID NO: 199702 - RNA, 1410 nt, Artificial Sequence
  derived and/or modified sequence opt5 from neuraminidase__InfluenzaA__ACO94511
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaagaccacucuauuguuuccagcuacguguguucuggacuugucggcgauacgccccggaagaacgacagcuccucuagcuccaauugccuggauccgaacaaugaggaaggcgggcauggagugaaaggcugggccuucgacgaugggaacgacguuuggaugggacgcaccaucagcgagaagucuagacucggcuaugagacauuuaaagugaucgaagggugguccaauccuaagagcaaacugcagauuaaccggcaggucaucguggaucgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgacggggcugauauuaaccugaugccuaucuga

SEQ ID NO: 199703 - RNA, 1410 nt, Artificial Sequence; identical to SEQ ID NO: 199536
  derived and/or modified sequence opt5 from neuraminidase__InfluenzaA__ACO94512

SEQ ID NO: 199704 - RNA, 1410 nt, Artificial Sequence; identical to SEQ ID NO: 199623
  derived and/or modified sequence opt5 from neuraminidase__InfluenzaA__ACO94513

SEQ ID NO: 199705 - RNA, 1410 nt, Artificial Sequence
  derived and/or modified sequence opt5 from neuraminidase__InfluenzaA__ACO94675
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguacgguggucaugaccgauggauccgcuagcggcaaggccgacacaaaaauccucuuuaucgaggaagggaagauuguucauaccuccacacugucuggaagcgcgcaacacguggaggaaugcuccugcuauccuagauaccccggcgugcggugugucugccgcgauaacuggaaggggagcaacagaccuaucguggacauuaauaucaaaaaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugccuaucuga

SEQ ID NO: 199706 - RNA, 1410 nt, Artificial Sequence
  derived and/or modified sequence opt5 from neuraminidase__InfluenzaA__ACO94686
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaaccauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagauauccugcgcacacaggagucugaaugugucugcauuaaugggacguguaccguggugaugacagacggauccgcuagcggcaaggccgauaccaaaauccucuuuaucgaggaggggaagauuguccauacauccacccugucuggaagcgcgcaacacguugaagagugcuccugcuauccuagauaccccggcgugcggugugugugccgcgacaacuggaaggggagcaacagaccuaucgucgacauuaauaucaaagaucacucuauuguguccagcuacguuuguucuggacuugugggcgacacgccccggaagaacgauagcuccucuagcggccauugccuggacccgaauaacgaagagggagggcacggcgucaaagggugggccuucgaugacggaaaugauguguggaugggccgcacaaucuccgaaaagagcagacucggguaugagaccuuuaaaguuaucgagggauggucuaacccuaaguccaaacugcagauuaaucgccaggugaucgucgaccggggcaacagaagcggcuacucugggauuuucuccguggaaggaaagagcuguaucaaucggugcuuuuaugucgagcugauuagaggccgcaaggaagagaccgaagugcucuggacauccaacucuaucguuguguucugugggaccagcggaacauacggcacgggguccuggcccgauggcgcugagauuaaucugaugccuaucuga

SEQ ID NO: 199707 - RNA, 1410 nt, Artificial Sequence; identical to SEQ ID NO: 199623
  derived and/or modified sequence opt5 from neuraminidase__InfluenzaA__ACO94697

SEQ ID NO: 199708 - RNA, 1413 nt, Artificial Sequence; identical to SEQ ID NO: 199656
  derived and/or modified sequence opt5 from neuraminidase__InfluenzaA__ACO94708

SEQ ID NO: 199709 - RNA, 1410 nt, Artificial Sequence
  derived and/or modified sequence opt5 from neuraminidase__InfluenzaA__ACO94719
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagauauucugcgcacccaggagucugaaugugucugcaucaaugggacauguacgguggugaugaccgacggauccgcuagcggcaaggccgauacaaaaauccucuuuauugaggaggggaagaucguccauaccuccacacugucuggaagcgcgcaacacguugaagagugcuccugcuauccuagauaccccggcgugcggugugugugccgcgacaacuggaaggggagcaacagaccuauugucgacaucaauauuaaagaucacucuaucguguccagcuacguuuguucuggacuugugggcgacacgccccggaagaacgauagcuccucuagcggccauugccuggacccgaauaacgaagagggagggcacggcgucaaagggugggccuucgaugacggaaaugauguguggaugggccgcaccaucuccgaaaagagcagacucggguaugagacauuuaaaguuauugagggauggucuaacccuaaguccaaacugcagaucaaucgccaggugauugucgaccggggcaacagaagcggcuacucugggaucuucuccguggaaggaaagagcuguauuaaucggugcuuuuaugucgagcugaucagaggccgcaaggaagagaccgaagugcucuggaccuccaacucuauuguuguguucugugggacaagcggaaccuacggcacaggguccuggcccgauggcgcugagaucaaucugaugccuaucuga

SEQ ID NO: 199710 - RNA, 1410 nt, Artificial Sequence
  derived and/or modified sequence opt5 from neuraminidase__InfluenzaA__ACO94741
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccaucgugagcuggucuaaagagauucugcgcacccaggaauccgagugugucugcaucaacgggacauguacgguggugaugaccgacggaagcgcuuccggcaaggccgauacaaaaauccucuuuauugaggaagggaagaucguccauaccucuacacugagcggauccgcgcaacacguugaggaaugcagcugcuaucccagauacccuggcgugcggugugugugccgcgacaacuggaaggggucuaauagacccauugucgauaucaacauuaaagaccacuccaucgugagcucuuacguuuguagcggacuugugggcgacaccccucggaagaaugauuccucuagcuccagccauugccuggaccccaacaaugaggaaggcgggcacggagucaaaggcugggccuucgaugacgggaacgauguguggaugggacgcacgaucucugagaaguccagacucggcuaugagacauuuaaaguuauugaaggguggagcaauccgaagucuaaacugcagaucaaccgccaggugauugucgaccggggaaauagauccggcuacagcggcaucuucuccguggagucuaagagcuguauuaaccggugcuuuuaugucgaacugaucagagggcgcaaggaggaaaccgaggugcucuggaccuccaauucuauuguuguguucuguggaacaagcggcaccuacgggacaggauccuggccugauggcgcugacaucaaccugaugcccaucuga

SEQ ID NO: 199711 - RNA, 1410 nt, Artificial Sequence; identical to SEQ ID NO: 199627
  derived and/or modified sequence opt5 from neuraminidase__InfluenzaA__ACO94763

SEQ ID NO: 199712 - RNA, 1410 nt, Artificial Sequence
  derived and/or modified sequence opt5 from neuraminidase__InfluenzaA__ACO94774
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauggccugguccucuagcuccugucaugacggacgggccuggcugcacgugugcauuacaggcgaugacaaaaacgcuaccgccagcuucaucuacaauggccgccuuguugauucuguggucuccuggagcaaggagauucugagaacccaggaaucugagugugugugcaucaacgggacauguacgguggucaugaccgacggauccgcuagcggcaaagccgauacaaagauucucuuuaucgaggaagggaaaaucguucauaccuccacacugucuggaagcgcgcaacacguggaggaaugcuccugcuauccucgguaccccggcgugcgcugugucugcagagacaacuggaaggggagcaaucggccuauuguggauaucaacauuaaggaccacucuaucguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccauuagcgagaaaucucggcucggcuaugagacauuuaaggugaucgaagggugguccaauccuaaaagcaagcugcagaucaaccgccaggucauuguggacagaggaaaucggucuggcuacuccggcaucuucagcgucgaggggaaauccuguauuaacagaugcuuuuauguggaacugauccgcggacggaaggaggaaaccgagguucucuggaccucuaauagcauuguggucuucuguggcacauccgggaccuacggaacaggcucuuggcccgauggggcugacaucaaccugaugccuauuuga

SEQ ID NO: 199713 - RNA, 1410 nt, Artificial Sequence
  derived and/or modified sequence opt5 from neuraminidase__InfluenzaA__ACO94785
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuguaagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgaaaaaucuagacucggcuaugagacauuuaaggugaucgaggggugguccaauccuaaaagcaagcugcagauuaaccggcaggucaucguggaccgcggaaauagaucuggcuacuccggcauuuucagcgucgaagggaaguccuguaucaaccggugcuuuuauguggagcugauuagaggacgcaaagaagagaccgaaguucucuggaccucuaauagcaucguggucuucuguggcacauccgggaccuacggaacaggcucuuggcccgauggggcugacauuaaccugaugccuaucuga

SEQ ID NO: 199714 - RNA, 1410 nt, Artificial Sequence; identical to SEQ ID NO: 199623
  derived and/or modified sequence opt5 from neuraminidase__InfluenzaA__ACO94796

SEQ ID NO: 199715 - RNA, 1413 nt, Artificial Sequence
  derived and/or modified sequence opt5 from neuraminidase__InfluenzaA__ACO94807
augaaccccaaucagaagaucauuaccaucggcagcauuuccaucgccauugggaucaucucucugauucuccaaaucggaaacauuaucagcauuugggcuucccacucuauccagacaggcagccagaaucauacggggauuugcaaccagagaaucaucaccuacgaaaauuccacaugggugaacaauaccuaugucaacauuaauaacacaaauguuguggccgagaaagacaagaccucugugacacuggcgggaaacagcucccuuuguagcaucucuggcugggcuauuuacaccaaagauaauuccauccggauugggagcaagggagacgucuucgugauccgcgagccuuuuaucucuugcucccaccuggaauguagaacguucuuucucacccaaggcgcccugcuuaacgauaaacauagcaauggcacaguuaaggaccggucuccguaucgcgcccugauguccugcccccucggggaggcuccuagccccuacaacuccagauucgaaucuguggccuggagcgcuuccgccugucacgauggaaugggcuggcugaccauugggaucagcggaccugacaacggcgcggucgccgugcugaaguauaaugggauuaucacagagaccauuaaaucuuggaagaaacggauccuccgcacgcaggaguccgaaugcguuuguaugaacggaagcugcuuuacaaucaugaccgauggccccucuaauggcacagcuagcuacaagauuuucaaaaucgagaaggggaaggugaccaaaaccauugaacugaacgccccuaauuuucauuaugaggaguguuccugcuacccggacacaggaacggucaugugugugugcagagauaacuggcacggcucuaaucggcccugggugagcuucaaccagaaucuugacuaccagaucggguauauuugcuccggagucuuuggcgauaacccucgccccaaggacggggaaggaagcuguaauccuguuaccguggauggcgcugacggcgugaaaggguucucuuacaaguauggaaacggcgucuggaucgggagaacaaaauccaaucggcugcgcaagggauuugagaugauuugggaccccaacggcuggaccaauacagauagcgacuucucugugaaacaagauguuguggccaucaccgacugguccggguacagcggcuccuuuguccagcacccggaacucacgggacuggauugcaucagaccuuguuucuggguggagcuuguucggggccugccccgcgaaaacacaaccauuuggaccucugggagcuccaucucuuucugcggagugaacagcggcacagcgaauugguccuggccugacggggccgagcuccccuuuaccauugauaaguga

SEQ ID NO: 199716 - RNA, 1410 nt, Artificial Sequence; identical to SEQ ID NO: 199438
  derived and/or modified sequence opt5 from neuraminidase__InfluenzaA__ACO94818

SEQ ID NO: 199717 - RNA, 1365 nt, Artificial Sequence; identical to SEQ ID NO: 198743
  derived and/or modified sequence opt5 from neuraminidase__InfluenzaA__ACO94829

SEQ ID NO: 199718 - RNA, 1365 nt, Artificial Sequence; identical to SEQ ID NO: 198743
  derived and/or modified sequence opt5 from neuraminidase__InfluenzaA__ACO94840

SEQ ID NO: 199719 - RNA, 1410 nt, Artificial Sequence
  derived and/or modified sequence opt5 from neuraminidase__InfluenzaA__ACO94851
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauaucguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgaucggggaaacagaucuggcuacuccggcaucuucagcguggaggggaaguccuguauuaaucggugcuuuuaugucgaacugaucagaggacgcaaggaggaaaccgaggugcucuggaccucuaacagcauuguuguguucuguggcacauccgggaccuacggaacaggcucuuggcccgacggggcugauaucaaucugaugccuaucuga

SEQ ID NO: 199720 - RNA, 1413 nt, Artificial Sequence; identical to SEQ ID NO: 199656
  derived and/or modified sequence opt5 from neuraminidase__InfluenzaA__ACO94873

SEQ ID NO: 199721 - RNA, 1410 nt, Artificial Sequence
  derived and/or modified sequence opt5 from neuraminidase__InfluenzaA__ACO94884
augaaccccaaucagaagaucauuaccaucggcagcgugucccugacaauugccacgaucugcuuccucaugcaaauugcuauccuggucaccacaguuacccuucacuuuaaacagcaugaguguaacucuccuccgaauaaccaggugaugcugugcgaacccacaaucauugagagaaauaucaccgaaauuguguaccucacaaacaccacgaucgagaaggaaauguguccuaaacuggccgaguaucggaauuggagcaagccccagugcaacauuaccggguucgcgccuuuuuccaaagacaauucuauccgccuuagcgcuggaggcgauauuugggucacaagagagcccuacguguccugugacccugauaagugcuaucaauucgcccuggggcagggaaccacacucaacaauggccacucuaacgacaccguucaugaucggacgccguaccgcacacugcugaugaaugaacucggggugcccuuucaccugggaaccagacaggucuguaucgccuggagcuccagcucuugccaugacggcaaggcuuggcuucacguguguguuacaggcgaugacaaaaacgccaccgcuuccuucaucuauaaugggcggcugguggauagcauuggaucuugguccaagaaaauccuccgcacccaggagagcgaaugcgucuguauuaacggcacaugcacgguggugaugaccgacgggucugccuccggaaaggcggauacaaaaauccuguuuauugaggagggcaagaucguccacaucagcacccuuuccgggucugcccaacauguugaagagugcagcuguuacccuagauaucccggagugcggugcgugugucgcgacaacuggaagggcuccaauagaccuauugucgauaucaacgugaaagacuacagcauuguuucuuccuacgugugcagcggccuggucggggacacaccccggaagaaugauucuuucagcuccucucacugucucgacccgaacaaugaagagggaggccauggggugaaaggaugggcuuuugaugacggcaacgauguuuggauggggcgcaccaucagcgaaaagcugagauccggauaugagacguucaaagugauugagggcuggagcaagccuaauucuaaacugcagaucaaccggcaggucaucguggaacgcggcaauagauccggguacagcggaaucuuuucugucgagggcaaguccugcauuaaccgguguuucuauguggaacucauuagagggcgcaaggaggaaacagagguuugguggaccagcaauuccaucguggucuuuugcggaaccucuggcacauacgggaccggcagcuggcccgacggagccgauauuaaccugaugccuaucuga

SEQ ID NO: 199722 - RNA, 1410 nt, Artificial Sequence; identical to SEQ ID NO: 197738
  derived and/or modified sequence opt5 from neuraminidase__InfluenzaA__ACO94906

SEQ ID NO: 199723 - RNA, 1410 nt, Artificial Sequence; identical to SEQ ID NO: 197169
  derived and/or modified sequence opt5 from neuraminidase__InfluenzaA__ACO94917

SEQ ID NO: 199724 - RNA, 1410 nt, Artificial Sequence; identical to SEQ ID NO: 197738
  derived and/or modified sequence opt5 from neuraminidase__InfluenzaA__ACO94928

SEQ ID NO: 199725 - RNA, 1410 nt, Artificial Sequence; identical to SEQ ID NO: 197169
  derived and/or modified sequence opt5 from neuraminidase__InfluenzaA__ACO94939

SEQ ID NO: 199726 - RNA, 1410 nt, Artificial Sequence
  derived and/or modified sequence opt5 from neuraminidase__InfluenzaA__ACO94950
augaaccccaaucagaagaucauuaccaucggcagcgugucccugacaauuucuacgaucugcuuccucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguuugccccuuucucuaaagauaacagcauccgccuuuccgcgggaggcgacaucugggugacaagagagcccuaugucucuugcgauccugacaaguguuaccaauuugcucuggggcagggaaccacacucaauaacgugcauagcaaugauaccguucacgaccggacgccguaucgcacacugcugaugaacgaacucggcgugcccuuccaucuggggaccaagcaggucugcauugccugguccucuagcuccugucacgauggaaaagccuggcuucaugugugcguuacaggcgacgauaagaaugcuaccgccagcuuuaucuacaacggcagacugguggacucuauugucuccuggagcaaaaagauccuccggacccaggagucugaaugugugugcauuaaugggacauguacgguggucaugaccgauggauccgcuagcggcaaagccgacacaaagauccuguucaucgaggaggggaagauuguucacaccuccacacuuucuggaagcgcgcaacacguggaagagugcuccugcuauccucgcuaccccggcgugagaugugucugccgggauaacuggaaagggagcaaccgcccuaucguggacauuaauaucaaggacuacucuauuguuuccagcuauguguguucuggacuggucggcgauacccccagaaagaacgacagcuccucuagcucccauugccucgauccgaauaacgaagagggcgggcacggagugaaaggcugggccuuugacgaugggaaugacguuuggaugggacggacgaucagcgaaaaacugcgcucuggcuacgagacauucaaggugaucgaggggugguccaacccuaauagcaaacugcagauuaacagacaggucaucguggaucggggaaaucgcucuggcuauuccggcauuuuuagcgucgaagggaaguccuguaucaacagaugcuucuacguggagcucauucggggaagaaaggaagagaccgaaguucuguggaccucuaauagcaucguggucuuuuguggcacauccgggaccuauggaacaggcucuuggcccgacggggcugauauuaaccuuaugccuaucuga

SEQ ID NO: 199727 - RNA, 1410 nt, Artificial Sequence
  derived and/or modified sequence opt5 from neuraminidase__InfluenzaA__ACO94961
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaacucugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaaugauaccguucacgaccggacgccguaucgcacacugcugaugaacgaacucggcgugcccuuucaucuggggaccaagcaggucugcaucgccugguccucuagcuccugucacgauggaaaagccuggcuucaugugugcguuacaggcgacgauaagaaugcuaccgccagcuucauuuacaacggcagacugguggacucuaucgucuccuggagcaaaaagauucuccggacccaggagucugaaugugugugcaucaaugggacauguacgguggucaugaccgauggauccgcuagcggcaaagccgacacaaagauucuguuuaucgaggaggggaagaucguucacaccuccacacuuucuggaagcgcgcaacacguggaagagugcuccugcuauccucgcuaccccggcgugagaugugucugccgggauaacuggaaagggagcaaccgcccuauuguggacaucaauauuaaggacuacucuaucguuuccagcuauguguguucuggacuggucggcgauacccccagaaagaacgacagcuccucuagcucccauugccucgauccgaauaacgaagagggcgggcacggagugaaaggcugggccuucgacgaugggaaugacguuuggaugggacggacgauuagcgaaaaacugcgcucuggcuacgagacauuuaaggugaucgaggggugguccaacccuaauagcaaacugcagaucaacagacaggucauuguggaucggggaaaucgcucuggcuauuccggcaucuucagcgucgaagggaaguccuguauuaacagaugcuuuuacguggagcucauccggggaagaaaggaagagaccgaaguucuguggaccucuaauagcauuguggucuucuguggcacauccgggaccuauggaacaggcucuuggcccgacggggcugauaucaaccuuaugccuauuuga

SEQ ID NO: 199728 - RNA, 1410 nt, Artificial Sequence
  derived and/or modified sequence opt5 from neuraminidase__InfluenzaA__ACO94972
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacgagaacgcuaccgccagcuucaucuacaauggcagacuuguggauucugucguguccuggagcaagaaaauucugcggacccaggaaucugagugugugugcaucaacgggacauguacggucguuaugaccgacggauccgcuagcggcaaggccgauacaaaaauucucuuuaucgaggaagggaagaucgugcacaccuccacacugucuggaagcgcgcaacacguggaggaaugcuccugcuauccucgcuaccccggcgucagaugugugugccgggacaacuggaaggggagcaaucgcccuauuguugauaucaacauuaaagacuacucuaucguguccagcuaugucuguucuggacuugugggcgacacccccagaaagaaugauagcuccucuagcucccauugccuggacccgaacaaugaggaaggcgggcacggaguuaaaggcugggccuucgaugacgggaacgauguguggaugggacggacgauuagcgagaagcuccgcucuggcuacgagacauuuaaagucaucgaagggugguccaauccuaacagcaagcugcagaucaauagacaggugauugucgaccggggaaaccgcucuggcuauuccggcaucuucagcguggaggggaaauccuguauuaauagaugcuuuuacguugaacugauccggggaagaaaccaggagaccgaagugcucuggaccucuaauagcauugucguguucuguggcacauccgggaccuauggaacaggcucuuggcccgauggggcugacaucaaccugaugccuauuuga

SEQ ID NO: 199729 - RNA, 1410 nt, Artificial Sequence
  derived and/or modified sequence opt5 from neuraminidase__InfluenzaA__ACO95156
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaccugcccuaaacucgcugaguaccggaauugguccaagccccaguguaacaucacaggguucgccccuuuuucuaaagacaauagcauucgccuguccgcgggaggcgauaucugggugaccagagagcccuaugucucuugcgacccugauaaguguuaccaauucgcucuugggcagggaacaacccugaacaaugugcauagcaacgacacgguucacgaucggacaccguaucgcacccuccugaugaaugaacugggcgugcccuuucaucucgggacaaagcaggucugcaucgccugguccucuagcuccugucacgacggaaaagccuggcugcaugugugcauuaccggcgaugacaagaacgcuaccgccagcuucaucuacaauggcagacuuguugauucuguggucuccuggagcaaaaagauucugcggacacaggagucugaaugugugugcaucaacgggacguguaccguggucaugacagacggauccgcuagcggcaaagccgauaccaagauucucuuuaucgaggaggggaagaucguucacacauccacccugucuggaagcgcgcaacacguggaagagugcuccugcuauccucgcuaccccggcgugagaugugucugccgggacaacuggaaagggagcaaucgcccuauuguggauaucaacauuaaggacuacucuaucguuuccagcuauguguguucuggacuugucggcgacacgccccggaaaaaugauagcuccucuagcucccauugccuggacccgaacaaugaagagggcgggcacggagugaagggcugggccuucgaugacgggaacgauguuuggaugggaagaacaauuagcgaaaaacuccgcucuggcuacgagaccuuuaaggugaucgaggggugguccaauccuaacagcaaacugcagaucaauagacaggucauuguggaccggggaaaccgcucuggcuauuccggcaucuucagcgucgaagggaaguccuguauuaauagaugcuuuuacguggagcugauccggggaagaaaccaggaaaccgagguucucuggacaucuaauagcauuguggucuucuguggcaccuccgggacauauggaacgggcucuuggcccgauggggcugacaucaaccugaugccuauuuga

SEQ ID NO: 199730 - RNA, 1410 nt, Artificial Sequence; identical to SEQ ID NO: 197351
  derived and/or modified sequence opt5 from neuraminidase__InfluenzaA__ACO95174

SEQ ID NO: 199731 - RNA, 1410 nt, Artificial Sequence; identical to SEQ ID NO: 197351
  derived and/or modified sequence opt5 from neuraminidase__InfluenzaA__ACO95185

SEQ ID NO: 199732 - RNA, 1410 nt, Artificial Sequence
  derived and/or modified sequence opt5 from neuraminidase__InfluenzaA__ACO95196
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccauucacgaucggacgccguaucgcacacuccugaugaaugaacugggcguucccuuucaucucgggaccaaacaggugugcaucgccugguccucuagcuccugucacgacggaaaagccuggcugcaugucugcgugacaggcgaugacaagaacgcuaccgccagcuucauuuacaauggcagacuuguugauucuguggucuccuggagcaaaaagauccugcggacccaggagucugaaugugugugcauuaacgggacauguacgguggucaugaccgacggauccgcuagcggcaaagccgauacaaagauccucuuuaucgaggaggggaagauuguucacaccuccacacugucuggaagcgcgcaacacguggaagagugcuccugcuauccucgcuaccccggcgugagaugugucugccgggacaacuggaaagggagcaaucgcccuaucguggauauuaacaucaaggacuacucuauuguuuccagcuauguguguucuggacuugucggcgacacccccagaaagaaugauagcuccucuagcucccauugccuggacccgaacaaugaagagggcgggcacggagugaagggcugggccuucgaugacgggaacgauguuuggaugggacggacgaucagcgaaaaacuccgcucuggcuacgagacauuuaaggugaucgaggggugguccaauccuaacagcaaacugcagauuaauagacaggucaucguggaccggggaaaccgcucuggcuauuccggcauuuucagcgucgaagggaaguccuguaucaauagaugcuuuuacguggagcugauucggggaagaaaccaggaaaccgagguucucuggaccucuaauagcaucguggucuucuguggcacauccgggaccuauggaacaggcucuuggcccgauggggcugacauuaaccugaugccuaucuga

SEQ ID NO: 199733 - RNA, 1410 nt, Artificial Sequence; identical to SEQ ID NO: 197351
  derived and/or modified sequence opt5 from neuraminidase__InfluenzaA__ACO95207

SEQ ID NO: 199734 - RNA, 1410 nt, Artificial Sequence; identical to SEQ ID NO: 197351
  derived and/or modified sequence opt5 from neuraminidase__InfluenzaA__ACO95218

SEQ ID NO: 199735 - RNA, 1410 nt, Artificial Sequence; identical to SEQ ID NO: 197354
  derived and/or modified sequence opt5 from neuraminidase__InfluenzaA__ACO95229

SEQ ID NO: 199736 - RNA, 1410 nt, Artificial Sequence; identical to SEQ ID NO: 197736
  derived and/or modified sequence opt5 from neuraminidase__InfluenzaA__ACO95240

SEQ ID NO: 199737 - RNA, 1410 nt, Artificial Sequence; identical to SEQ ID NO: 197597
  derived and/or modified sequence opt5 from neuraminidase__InfluenzaA__ACO95262

SEQ ID NO: 199738 - RNA, 1410 nt, Artificial Sequence; identical to SEQ ID NO: 199535
  derived and/or modified sequence opt5 from neuraminidase__InfluenzaA__ACO95273

SEQ ID NO: 199739 - RNA, 1410 nt, Artificial Sequence; identical to SEQ ID NO: 199627
  derived and/or modified sequence opt5 from neuraminidase__InfluenzaA__ACO95306

SEQ ID NO: 199740 - RNA, 1413 nt, Artificial Sequence
  derived and/or modified sequence opt5 from neuraminidase__InfluenzaA__ACO95385
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucugacaaggcugccagcuacaaaaucuucaagauugaaaagggaaaagugacaaaguccaucgagcugaaugcuccuaacuuucauuaugaagaguguucuugcuacccggauaccggcauugucaugugugugugccgggacaauuggcacgggagcaaccgccccuggguguccuucaaucagaaccuugauuaccaaaucggauauauuugcagcggcgucuuuggggacaauccuagacccgaggauggagaaggcucuuguaacccuguuaccguggacggcgccaauggggugaaaggauucuccuacaaguaugacaacggcgucuggaucgggcggacaaaaagcaaucgccugagaaagggauuugagaugauuugggaucccaacggcuggacgaauaccgacucugauuucuccgugaaacaggacguuguggcgaucacagauuggagcggguacuccggcucuuuuguccagcacccggaacucaccggacuggacugcauccggccuuguuucuggguggagcuuguucgcggccugcccagagaaaacacaaccauuuggacgagcggguccucuaucagcuucugcggagugaacuccgauacagccaauuggagcuggccugacggcgcugagcuccccuuuaccauugauaaguga

SEQ ID NO: 199741 - RNA, 1413 nt, Artificial Sequence; identical to SEQ ID NO: 199656
  derived and/or modified sequence opt5 from neuraminidase__InfluenzaA__ACO95407

SEQ ID NO: 199742 - RNA, 1413 nt, Artificial Sequence; identical to SEQ ID NO: 199656
  derived and/or modified sequence opt5 from neuraminidase__InfluenzaA__ACO95418

SEQ ID NO: 199743 - RNA, 1410 nt, Artificial Sequence; identical to SEQ ID NO: 197169
  derived and/or modified sequence opt5 from neuraminidase__InfluenzaA__ACO95429

SEQ ID NO: 199744 - RNA, 1410 nt, Artificial Sequence; identical to SEQ ID NO: 197738
  derived and/or modified sequence opt5 from neuraminidase__InfluenzaA__ACO95440

SEQ ID NO: 199745 - RNA, 1410 nt, Artificial Sequence
  derived and/or modified sequence opt5 from neuraminidase__InfluenzaA__ACO95462
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucucuggaccucuaacagcaucguggucuucuguggcacauccgggaccuauggaacaggcucuuggcccgauggggcugacauuaaucugaugcuuaucuga

SEQ ID NO: 199746 - RNA, 1410 nt, Artificial Sequence; identical to SEQ ID NO: 197736
  derived and/or modified sequence opt5 from neuraminidase__InfluenzaA__ACO95484

SEQ ID NO: 199747 - RNA, 1410 nt, Artificial Sequence; identical to SEQ ID NO: 197736
  derived and/or modified sequence opt5 from neuraminidase__InfluenzaA__ACO95495

SEQ ID NO: 199748 - RNA, 1410 nt, Artificial Sequence; identical to SEQ ID NO: 197736
  derived and/or modified sequence opt5 from neuraminidase__InfluenzaA__ACO95506

SEQ ID NO: 199749 - RNA, 1410 nt, Artificial Sequence
  derived and/or modified sequence opt5 from neuraminidase__InfluenzaA__ACO95517
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgccugggcuacgagacauuuaaagugaucgaaggguggucuaauccuaacuccaagcugcagauuaauagacaggucaucguggaccggggaaaccgcagcggcuauucuggcauuuucuccgucgaggggaaaagcuguaucaauagaugcuuuuacguggaacucauucggggaagaaaggaggaaaccgagguucuguggaccuccaacucuaucguggucuucuguggcacaagcgggaccuauggaacaggcuccuggcccgauggggcugacauuaaucuuaugccuaucuga

SEQ ID NO: 199750 - RNA, 1410 nt, Artificial Sequence
  derived and/or modified sequence opt5 from neuraminidase__InfluenzaA__ACO95539
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccaacacaaaaauccucuuuaucgaggaagggaagauuguucacaccuccacacugucuggaagcgcgcaacacguggaggaaugcuccugcuauccucgcuaccccggcgugagaugugucugccgggauaauuggaaggggagcaaccgcccuaucguggacauuaauaucaaagauuacucuauuguuuccagcuauguguguucuggacuugucggcgacacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 199751 - RNA, 1413 nt, Artificial Sequence
  derived and/or modified sequence opt5 from neuraminidase__InfluenzaA__ACP20223
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucugacuucuccgugaaacaggauguuguggcggucacagacuggagcggguacuccggcucuuuugugcagcacccggaacucaccggacuggauugcauccggccuuguuucuggguugagcuugugcgcggccugcccagagaaaacacaaccaucuggacgagcggguccucuauuagcuucugcggagucaauuccgacacagccaacuggagcuggccugauggcgcugagcuccccuuuaccaucgacaaguga

SEQ ID NO: 199752 - RNA, 1410 nt, Artificial Sequence
  derived and/or modified sequence opt5 from neuraminidase__InfluenzaA__ACP41952
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucgucggcaucaacgaaugguccggguacucuggcagcuucgugcagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuuggcccgacggggcugagcugccuuucaccauugauaaguga

SEQ ID NO: 199753 - RNA, 1410 nt, Artificial Sequence; identical to SEQ ID NO: 199752
  derived and/or modified sequence opt5 from neuraminidase__InfluenzaA__ACP44158

SEQ ID NO: 199754 - RNA, 1413 nt, Artificial Sequence
  derived and/or modified sequence opt5 from neuraminidase__InfluenzaA__ACP44195
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucugacaaggcugccagcuacaaaaucuucaagauugaaaagggaaaagugacaaaguccaucgagcugaaugcuccuaacuuucauuaugaagaguguucuugcuacccggauaccggcauugucaugugugugugccgggacaauuggcacgggagcaaccgccccuggguguccuucaaucagaaccuugauuaccaaaucggauauauuugcagcggcgucuuuggggacaauccuagacccgaggauggagaaggcucuuguaacccuguuaccguggacggcgccaauggggugaaaggauucuccuacaaguaugacaacggcgucuggaucgggcggacaaaaagcaaucgccugagaaagggauuugagaugauuugggaucccaacggcuggacgaauaccgacucugauuucuccgugaaacaggacguuguggcgaucacagauuggagcggguacuccggcucuuuuguccagcacccggaacucaccggacugaacugcauccggccuuguuucuggguggagcuuguucgcggccugcccagagaaaacacaaccauuuggacgagcggguccucuaucagcuucugcggagucaauuccgacacagccaacuggagcuggccugauggcgcugagcuccccuuuaccauugacaaguga

SEQ ID NO: 199755 - RNA, 1413 nt, Artificial Sequence; identical to SEQ ID NO: 199656
  derived and/or modified sequence opt5 from neuraminidase__InfluenzaA__ACP44217

SEQ ID NO: 199756 - RNA, 1413 nt, Artificial Sequence; identical to SEQ ID NO: 199656
  derived and/or modified sequence opt5 from neuraminidase__InfluenzaA__ACP44228

SEQ ID NO: 199757 - RNA, 1410 nt, Artificial Sequence; identical to SEQ ID NO: 197738
  derived and/or modified sequence opt5 from neuraminidase__InfluenzaA__ACP44239

SEQ ID NO: 199758 - RNA, 1410 nt, Artificial Sequence
  derived and/or modified sequence opt5 from neuraminidase__InfluenzaA__ACP44250
augaaccccaaucagaagaucauuaccaucggcagcgugucccugacaauuucuacgaucugcuucuuuaugcaaauugccauccucaugaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcaucgccugguccucuagcuccugucacgauggaaaagccuggcugcaugugugcguuacaggcgacgauaagaaugcuaccgccagcuucauuuacaacggcagacuuguggacucuaucgucuccuggagcaaagagauucugcggacccaggaaucugagugugugugcaucaaugggacauguacgguggucaugaccgauggauccgcuagcggcaaggccgacacaaaaauucucuuuaucgaggaagggaagaucguucacaccuccacacugucuggaagcgcgcaacacguggaggaaugcuccugcuauccucgcuaccccggcgugagaugugucugccgggauaacuggaaggggagcaaccgcccuauuguggacaucaauauuaaagacuacucuaucguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgauuagcgagaagcuccgcucuggcuacgagacauuuaaagugaucgaagggugguccaacccuaauagcaagcugcagaucaacagacaggucauuguggaucggggaaaucgcucuggcuauuccggcaucuucagcgucgaggggaaauccuguauuaacagaugcuuuuacguggaacugauccggggaagaaaggaggaaaccgagguucucuggaccucuaauagcauuguggucuucuguggcacauccgggaccuauggaacaggcucuuggcccgacggggcugauaucaaccugaugccuauuuga

SEQ ID NO: 199759 - RNA, 1410 nt, Artificial Sequence
  derived and/or modified sequence opt5 from neuraminidase__InfluenzaA__ACP44261
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaauaugcauagcaacgacaccgugcacgaucggacgccguaucgcacacuccugaugaaugaacugggcguucccuuucaucucgggaccaaacaggugugcauugccugguccucuagcuccugucacgacggaaaggccuggcugcaugucugcgugacaggcgaugacaagaacgcuaccgccagcuucaucuacaauggcagacuuguugauucuauuguguccuggagcaaagagauccugcggacccaggaaucugagugugucugcauuaacgggacauguacgguggugaugaccgacggauccgcuagcggcaaggccgauacaaaaauccucuuuaucgaggaagggaagauuguccacaccuccacacugucuggaagcgcgcaacacguugaggaaugcuccugcuauccucgcuaccccggcgugagaugugugugccgggacaacuggaaggggagcaaucgcccuaucgucgauauuaacaucaaagacuacucuauuguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuaucgaagggugguccaauccuaacagcaagcugcagauuaauagacaggugaucgucgaccggggaaaccgcucuggcuauuccggcauuuucagcguggaggggaaauccuguaucaauagaugcuuuuacgucgaacugauucggggaagaaaggaggaaaccgaggugcucuggaccucuaacagcaucguuguguucuguggcacauccgggaccuauggaacaggcucuuggcccgauggggcugacauuaaucugaugccuaucuga

SEQ ID NO: 199760 - RNA, 1410 nt, Artificial Sequence
  derived and/or modified sequence opt5 from neuraminidase__InfluenzaA__ACP44272
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacggugaucaugaccgacggauccgcuagcggcaaggccgauacaaaaauccucuuuauugaggaagggaagaucguccacaccuccacacugucuggaagcgcgcaacacguugaggaaugcuccugcuauccucgcuaccccggcgugagaugugugugccgggacaacuggaaggggagcaaucgcccuauugucgauaucaacauuaaagacuacucuaucguguccagcuauguuuguucuggacuugugggcgacacccccagaaagaaugauagcuccucuagcucccauugccuggacccgaacaaugaggaaggcgggcacggagucaaaggcugggccuucgaugacgggaacgauguguggaugggacggacgaucagcgagaagcuccgcucuggcuacgagacauuuaaaguuauugaagggugguccaauccuaacagcaagcugcagaucaauagacaggugauugucgaccggggaaaccgcucuggcuauuccggcaucuucagcguggaggggaaauccuguauuaauagaugcuuuuacgucgaacugauccggggaagaaaggaggaaaccgaggugcucuggaccucuaacagcauuguuguguucuguggcacauccgggaccuauggaacaggcucuuggcccgauggggcugacaucaaucugaugccuaucuga

SEQ ID NO: 199761 - RNA, 1410 nt, Artificial Sequence; identical to SEQ ID NO: 199752
  derived and/or modified sequence opt5 from neuraminidase__InfluenzaA__ACQ55360

SEQ ID NO: 199762 - RNA, 1410 nt, Artificial Sequence
  derived and/or modified sequence opt5 from neuraminidase__InfluenzaA__ACQ63236
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 199763 - RNA, 1410 nt, Artificial Sequence; identical to SEQ ID NO: 199762
  derived and/or modified sequence opt5 from neuraminidase__InfluenzaA__ACQ63242

SEQ ID NO: 199764 - RNA, 1410 nt, Artificial Sequence; identical to SEQ ID NO: 199762
  derived and/or modified sequence opt5 from neuraminidase__InfluenzaA__ACQ63253

SEQ ID NO: 199765 - RNA, 1410 nt, Artificial Sequence; identical to SEQ ID NO: 199762
  derived and/or modified sequence opt5 from neuraminidase__InfluenzaA__ACQ63262

SEQ ID NO: 199766 - RNA, 1410 nt, Artificial Sequence
  derived and/or modified sequence opt5 from neuraminidase__InfluenzaA__ACQ65694
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggacauccugcgcacccaggagucugaaugugugugcauuaaugggacauguacgguggucaugaccgauggauccgcuagcggcaaagccgacacaaagauccucuuuaucgaggaggggaagauuguucauaccuccacacugucuggaagcgcgcaacacguggaagagugcuccugcuauccuagauaccccggcgugcggugugucugccgcgauaacuggagagggagcaaccggccuaucguggacauuaauaugaaagacuacucuaucguuuccagcuauguguguucuggacuugucggcgauacgccccgcaagaacgacagcuccucuagcggccacugccuggauccgaauaacgaagaagggggacauggcgugaaagggugggccuucgacgauggaaaugacguuuggaugggcagaaccauuuccgagaagcuccggagcggguacgagacauuuaaagugaucgagggauggucuaacccuaauuccaagcugcagaucaaccgccaggucauuguggauagaggcaaucggagcggcuauucugggaucuucuccgucgaaggaaaaagcuguauuaacagaugcuuuuacguggagcugauccgcggccggaaggaagagaccgaaguucucuggaccuccaauucuauuguggucuucugugggacaagcggaaccuauggcacaggguccuggcccgacggcgcugauaucaaccugaugccuauuuga

SEQ ID NO: 199767 - RNA, 1410 nt, Artificial Sequence
  derived and/or modified sequence opt5 from neuraminidase__InfluenzaA__ACQ65705
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagauaccccggcgugcggugugucugccgcgacaacuggagagggagcaaccggccuaucguggauauuaauaugaaagacuacucuaucguuuccagcuauguguguucuggacuugucggcgacacgccccgcaagaacgauagcuccucuagcggccacugccuggacccgaauaacgaggaagggggacauggcgugaaagggugggccuucgaugacggaaaugauguuuggaugggcagaaccauuuccgagaagcuccggagcggguacgagacauuuaaagugaucgaaggauggucuaacccuaauuccaagcugcagaucaaccgccaggucauuguggacagaggcaaucggagcggcuauucugggaucuucuccgucgagggaaaaagcuguauuaacagaugcuuuuacguggaacugauccgcggccggaaggaggaaaccgagguucucuggaccuccaauucuauuguggucuucugugggacaagcggaaccuauggcacaggguccuggcccgauggcgcugacaucaaccugaugccuauuuga

SEQ ID NO: 199768 - RNA, 1410 nt, Artificial Sequence; identical to SEQ ID NO: 199536
  derived and/or modified sequence opt5 from neuraminidase__InfluenzaA__ACQ65716

SEQ ID NO: 199769 - RNA, 1410 nt, Artificial Sequence; identical to SEQ ID NO: 199536
  derived and/or modified sequence opt5 from neuraminidase__InfluenzaA__ACQ65727

SEQ ID NO: 199770 - RNA, 1410 nt, Artificial Sequence; identical to SEQ ID NO: 199623
  derived and/or modified sequence opt5 from neuraminidase__InfluenzaA__ACQ65739

SEQ ID NO: 199771 - RNA, 1410 nt, Artificial Sequence
  derived and/or modified sequence opt5 from neuraminidase__InfluenzaA__ACQ65750
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucggaaccgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuauuguguccuggagcaaagagauccugcgcacacaggaaucugagugugucugcauuaacgggacguguaccguggugaugacagacggauccgcuagcggcaaggccgauaccaaaauccucuuuaucgaggaagggaagauuguccauacauccacccugucuggaagcgcgcaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcacaaucagcgagaagucuagacucggcuaugagaccuuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacugauuagaggacgcaaggaggaaaccgaggugcucuggacaucuaauagcaucguuguguucuguggcaccuccgggacauacggaacgggcucuuggcccgauggggcugacauuaaccugaugccuaucuga

SEQ ID NO: 199772 - RNA, 1413 nt, Artificial Sequence; identical to SEQ ID NO: 199656
  derived and/or modified sequence opt5 from neuraminidase__InfluenzaA__ACQ65761

SEQ ID NO: 199773 - RNA, 1410 nt, Artificial Sequence; identical to SEQ ID NO: 199752
  derived and/or modified sequence opt5 from neuraminidase__InfluenzaA__ACQ73394

SEQ ID NO: 199774 - RNA, 1410 nt, Artificial Sequence; identical to SEQ ID NO: 199752
  derived and/or modified sequence opt5 from neuraminidase__InfluenzaA__ACQ73395

SEQ ID NO: 199775 - RNA, 1410 nt, Artificial Sequence; identical to SEQ ID NO: 199762
  derived and/or modified sequence opt5 from neuraminidase__InfluenzaA__ACQ73396

SEQ ID NO: 199776 - RNA, 1410 nt, Artificial Sequence; identical to SEQ ID NO: 199762
  derived and/or modified sequence opt5 from neuraminidase__InfluenzaA__ACQ76291

SEQ ID NO: 199777 - RNA, 1410 nt, Artificial Sequence
  derived and/or modified sequence opt5 from neuraminidase__InfluenzaA__ACQ76298
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccaucaugacggauggaccgagcaauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 199778 - RNA, 1410 nt, Artificial Sequence; identical to SEQ ID NO: 199762
  derived and/or modified sequence opt5 from neuraminidase__InfluenzaA__ACQ76308

SEQ ID NO: 199779 - RNA, 1410 nt, Artificial Sequence; identical to SEQ ID NO: 199762
  derived and/or modified sequence opt5 from neuraminidase__InfluenzaA__ACQ76316

SEQ ID NO: 199780 - RNA, 1410 nt, Artificial Sequence; identical to SEQ ID NO: 199752
  derived and/or modified sequence opt5 from neuraminidase__InfluenzaA__ACQ76322

SEQ ID NO: 199781 - RNA, 1410 nt, Artificial Sequence; identical to SEQ ID NO: 199752
  derived and/or modified sequence opt5 from neuraminidase__InfluenzaA__ACQ76328

SEQ ID NO: 199782 - RNA, 1410 nt, Artificial Sequence; identical to SEQ ID NO: 199752
  derived and/or modified sequence opt5 from neuraminidase__InfluenzaA__ACQ76335

SEQ ID NO: 199783 - RNA, 1410 nt, Artificial Sequence; identical to SEQ ID NO: 199752
  derived and/or modified sequence opt5 from neuraminidase__InfluenzaA__ACQ76342

SEQ ID NO: 199784 - RNA, 1410 nt, Artificial Sequence; identical to SEQ ID NO: 199752
  derived and/or modified sequence opt5 from neuraminidase__InfluenzaA__ACQ76351

SEQ ID NO: 199785 - RNA, 1410 nt, Artificial Sequence; identical to SEQ ID NO: 199752
  derived and/or modified sequence opt5 from neuraminidase__InfluenzaA__ACQ76359

SEQ ID NO: 199786 - RNA, 1410 nt, Artificial Sequence; identical to SEQ ID NO: 199762
  derived and/or modified sequence opt5 from neuraminidase__InfluenzaA__ACQ76364

SEQ ID NO: 199787 - RNA, 1410 nt, Artificial Sequence; identical to SEQ ID NO: 199762
  derived and/or modified sequence opt5 from neuraminidase__InfluenzaA__ACQ76367

SEQ ID NO: 199788 - RNA, 1410 nt, Artificial Sequence
  derived and/or modified sequence opt5 from neuraminidase__InfluenzaA__ACQ76379
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacaaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaagggagaugucuuugugauccgggaaccguucauuagcuguucuccccucgagugccgcaccuuuuuccugacacagggcgcccuucugaaugacaaacauuccaacggcaccaucaaggauagaagcccuuaucggacgcucaugucuugucccauuggggaaguuccuucccccuacaacagccgcuuugaguccguggccuggucugcuagcgccugccacgacggaaucaauuggcugaccauuggcaucuccgggccugauaacggagcugucgccgugcugaaguauaauggcaucauuacagacaccaucaaaagcuggagaaacaauauucuccggacacaagaaucugagugugcgugcgugaacggguccuguuucaccgucaugacggauggaccgagcaauggccaggccucuuacaagaucuuucgcauugagaaaggcaagaucguuaaaagcguggaaaugaacgcucccaauuaucauuacgaggaaugcuccuguuacccugacucuagcgagaucacaugcgugugcagagauaacuggcacggguccaaucggcccugggucagcuucaaccagaaucuggaguaucagauuggauacaucuguucuggcauuuuuggggacaacccucgccccaaugauaagaccggauccugcggcccggugagcucuaacggggccaacggaguuaagggcuucuccuuuaaauauggcaaugggguguggaucggaagaacaaagagcauuuccucucggaacggcuucgaaaugaucugggacccuaauggguggaccggaaccgauaacaauuuuagcauuaaacaagacaucgucggcaucaacgagugguccggguacucuggcagcuucgugcagcaucccgaacuuacaggacuggacuguauucgcccuugcuucuggguugagcucaucagaggccggcccaaggaaaauacgauuuggaccuccgggagcucuaucuccuuuuguggagugaacagcgauacagucggcuggucuuggcccgacggggcugagcugccuuucaccauugauaaauga

SEQ ID NO: 199789 - RNA, 1410 nt, Artificial Sequence; identical to SEQ ID NO: 199762
  derived and/or modified sequence opt5 from neuraminidase__InfluenzaA__ACQ76385

SEQ ID NO: 199790 - RNA, 1410 nt, Artificial Sequence; identical to SEQ ID NO: 199762
  derived and/or modified sequence opt5 from neuraminidase__InfluenzaA__ACQ76388

SEQ ID NO: 199791 - RNA, 1410 nt, Artificial Sequence; identical to SEQ ID NO: 199762
  derived and/or modified sequence opt5 from neuraminidase__InfluenzaA__ACQ76403

SEQ ID NO: 199792 - RNA, 1410 nt, Artificial Sequence
  derived and/or modified sequence opt5 from neuraminidase__InfluenzaA__ACQ76407
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuggcgggugggcuauuuacuccaaggacaacagcgugagaaucggaucuaaaggcgaugucuuugugauccgggagccguucauuuccuguagcccccucgaaugccgcaccuuuuuccugacacagggcgcccuucugaaugacaagcauucuaacgggaccaucaaagauagauccccuuaucggacgcucaugagcugucccauuggagagguuccuucucccuacaacucccgcuuugaaagcguggccugguccgcuucugccugccacgacggcaucaauuggcugaccauugggaucagcggaccugauaacggcgcugucgccgugcugaaguauaaugggaucauuacagacaccaucaaguccuggagaaacaauauucuccggacacaagagagcgagugugcgugcgugaacggaucuuguuucaccgucaugacggauggcccguccaauggccaggccagcuacaaaaucuuucgcauugaaaaggggaaaaucguuaagucuguggagaugaacgcucccaauuaucauuacgaagagugcagcuguuacccugacuccucugagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguaugggaauggaguguggaucggcagaacaaaauccauuagcucccggaacggguucgagaugaucugggacccuaauggauggaccggcaccgauaacaauuuuucuauuaagcaagacaucgucgggaucaacgaauggagcggcuacuccggaucuuucgugcagcaucccgagcuuacaggccuggacuguauucgcccuugcuucuggguugaacucaucagagggcggcccaaagagaauacgauuuggaccagcggauccagcaucucuuuuuguggcgugaacuccgauacagucggguggagcuggcccgacggagcugagcugccuuucaccauugauaaguga

SEQ ID NO: 199793 - RNA, 1410 nt, Artificial Sequence
  derived and/or modified sequence opt5 from neuraminidase__InfluenzaA__ACQ77603
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaggcuuggcuucauguguguguuacaggcgaugacgagaacgccaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcccucuuuccgggucugcccaacacguugaggaaugcagcuguuauccccgcuacccuggagugagaugcgugugucgggacaacuggaagggcuccaaucgccccauugucgauaucaacgugaaagacuacagcauuguuucuuccuaugugugcagcggccuggucggggacacaccgagaaagaaugauucuagcuccucuagccauugucucgacccuaacaaugaggaaggaggccacggggugaaaggaugggcuuucgaugacggcaacgauguuuggauggggcggaccaucuccgagaaaagccgcucuggauacgagacguuuaaagugauugaaggcugguccaagcccaauagcaaacugcagaucaacagacaggucaucguggaccggggcaaucgcucuggguauuccggaauuuucagcgucgagggcaaguccugcaucaacagauguuuuuacguggaacugauucgggggagaaagcaggagacagaaguucucuggaccucuaauagcaucguggucuucugcggaaccuccggcacauaugggaccggcucuuggccugauggagccgacauuaaccugaugcccaucuga

SEQ ID NO: 199794 - RNA, 1410 nt, Artificial Sequence; identical to SEQ ID NO: 199752
  derived and/or modified sequence opt5 from neuraminidase__InfluenzaA__ACQ83309

SEQ ID NO: 199795 - RNA, 1410 nt, Artificial Sequence; identical to SEQ ID NO: 199752
  derived and/or modified sequence opt5 from neuraminidase__InfluenzaA__ACQ84460

SEQ ID NO: 199796 - RNA, 1410 nt, Artificial Sequence; identical to SEQ ID NO: 199752
  derived and/or modified sequence opt5 from neuraminidase__InfluenzaA__ACQ84470

SEQ ID NO: 199797 - RNA, 1410 nt, Artificial Sequence
  derived and/or modified sequence opt5 from neuraminidase__InfluenzaA__ACQ84480
augaacaccaaucagagaaucauuacaaucggcacggugugccugauugucgggaucguuagccuccugcuucaaauuggaaacaucgugucccuguggaucucucacagcauuaagaccggcgagaaaaaucauuccgaaaucuguaaccagaauauuaucacauacgagaacaagaccugggugaaucagacauaugucaacauuucuaauaccaacaucgccgacgggcagggagugacaagcauuauccucgcuggcaauuccucucugugccccaucagcgggugggccauuuacuccaaagauaacagcauccggauuggaucuaagggcgacaucuucguuauucgcgaaccuuuuaucuccuguagccaccuugagugcagaaccuucuuucugacgcaaggcgcgcuccugaaugaucggcauucuaacgggaccgugaaagaccgcuccccguauagaacacugaugagcugucccaccggagaagcuccuucucccuacaauucccgguucgagagcgucgccugguccgccucugcuugccacgauggcaugggguggcucacaaucggaauuagcggcccugacaacggggccguggcuguucugaaguauaacggaaucauuaccgauacgaucaaguccuggcgcaauaaaauucuuagaacacaggagagcgaaugugugugcaucaacggcucuuguuuuaccaucaugacagacggccccuccaaugggcaggccagcuacaagauuuucaaaauggagaagggaaaaaucauuaagucugucgaacuggaugcgccuaacuaucauuacgaggagugcagcuguuacccggacaccggcaagguggugugcgucugccgggauaauuggcacgccuccaaccgccccuggguuucuuuugaccagaaucucgauuaucaaaucggguacauuuguagcggaguguucggcgacaacccuagauccaaugacgggaaaggaaacugcggccccgugcugagcaauggcgcuaacggggucaagggauuuucuuuccgguauggcaaugggguguggaucggacgcaccaaauccauuagcucuagauccggcuuugaaaugaucugggauccuaacggguggacagagacggacagcuccuucucuaucaagcaggauauuaucgcccuuaccgacuggagcggcuacuccggaucuuuuguucagcaccccgaacugacaggcaugaauuguauucggccgugcuucuggguggagcucauccgcgggcagccuaaagaaagcaccauuuggacauccggaagcucuaucuccuucuguggcgucgauagcgagaccgcuucuugguccuggcccgacggggccgaucugccuuuuacgaucgacaaguga

SEQ ID NO: 199798 - RNA, 1410 nt, Artificial Sequence
  derived and/or modified sequence opt5 from neuraminidase__InfluenzaA__ACQ89891
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuugucgcggcaucuuuggggacaacccuagacccaaugauaaaaccggaucuugcggcccggucuccagcaacggggccaacggagugaagggcuucucuuuuaaguauggcaaugggguuuggauuggacggacaaaauccaucagcucccgcaacggcuucgagaugauuugggacccuaauggguggaccggaaccgauaacaauuuuucuaucaagcaagacaucgugggcauuaacgaauggagcggguacuccggcucuuucguccagcaucccgagcuuacaggacuggacuguaucagaccuugcuucuggguggaacucauucggggccgccccaaagagaauacgaucuggaccagcggguccagcauuucuuuuuguggaguuaacuccgauacagugggcuggagcuggcccgacggggcugagcugccuuucaccaucgauaaguga

SEQ ID NO: 199799 - RNA, 1410 nt, Artificial Sequence; identical to SEQ ID NO: 199752
  derived and/or modified sequence opt5 from neuraminidase__InfluenzaA__ACQ89918

SEQ ID NO: 199800 - RNA, 1410 nt, Artificial Sequence
  derived and/or modified sequence opt5 from neuraminidase__InfluenzaA__ACQ89919
augaaccccaaucagaagaucauuaccaucggcagcgugugcaugacaauugggauggccaaccugauccuccaaauuggaaauaucaucuccauuuggaucucuagaagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugcggaucggguccaaaggagaugucuuugugauccgcgagccguucauuagcuguucuccccucgaaugcagaaccuuuuuccugacacagggcgcccuucugaaugacaagcacuccaacggcaccaucaaagaucggagcccuuaucgcacgcucaugucuugucccauuggggagguuccuucccccuacaacagcagauuugaauccguggccuggucugcuagcgccugccaugacggaaucaauuggcugaccauuggcaucuccgggccugauaacggagcugucgccgugcugaaguauaauggcaucauuacagacaccaucaagagcuggcggaacaauauucuccgcacacaagagucugagugugcgugcgugaacggguccuguuucaccgucaugacggauggaccgagcaauggccaggccucuuacaaaaucuuuagaauugaaaagggcaaaaucguuaagagcguggagaugaacgcucccaauuaucacuacgaagagugcuccuguuacccugacucuagcgagaucacaugcgugugccgggauaacuggcauggguccaaucgccccugggucagcuucaaccagaaucuggaauaucagauuggauacaucuguucuggcauuuuuggggacaacccuagacccaaugauaaaaccggauccugcggcccggugagcucuaacggggccaacggaguuaagggcuucuccuuuaaguauggcaaugggguguggaucggacggacaaaaagcauuuccucucgcaacggcuucgagaugaucugggacccuaauggguggaccggaaccgauaacaauuuuagcauuaagcaagacaucgucggcaucaacgaaugguccggguacucuggcagcuucgugcagcaccccgagcuuacaggacuggacuguauuagaccuugcuucuggguugaacucauccggggccgccccaaagagaauacgauuuggaccuccgggagcucuaucuccuuuuguggagugaacagcgauacagucggcuggucuuggcccgacggggcugagcugccuuucaccauugauaaguga

SEQ ID NO: 199801 - RNA, 1410 nt, Artificial Sequence; identical to SEQ ID NO: 199762
  derived and/or modified sequence opt5 from neuraminidase__InfluenzaA__ACQ89920

SEQ ID NO: 199802 - RNA, 1410 nt, Artificial Sequence; identical to SEQ ID NO: 199762
  derived and/or modified sequence opt5 from neuraminidase__InfluenzaA__ACQ89921

SEQ ID NO: 199803 - RNA, 1410 nt, Artificial Sequence; identical to SEQ ID NO: 199752
  derived and/or modified sequence opt5 from neuraminidase__InfluenzaA__ACQ89922

SEQ ID NO: 199804 - RNA, 1410 nt, Artificial Sequence; identical to SEQ ID NO: 199762
  derived and/or modified sequence opt5 from neuraminidase__InfluenzaA__ACQ89923

SEQ ID NO: 199805 - RNA, 1410 nt, Artificial Sequence; identical to SEQ ID NO: 199752
  derived and/or modified sequence opt5 from neuraminidase__InfluenzaA__ACQ99623

SEQ ID NO: 199806 - RNA, 1410 nt, Artificial Sequence; identical to SEQ ID NO: 199762
  derived and/or modified sequence opt5 from neuraminidase__InfluenzaA__ACQ99624

SEQ ID NO: 199807 - RNA, 1410 nt, Artificial Sequence; identical to SEQ ID NO: 199752
  derived and/or modified sequence opt5 from neuraminidase__InfluenzaA__ACQ99626

SEQ ID NO: 199808 - RNA, 1410 nt, Artificial Sequence; identical to SEQ ID NO: 199752
  derived and/or modified sequence opt5 from neuraminidase__InfluenzaA__ACQ99627

SEQ ID NO: 199809 - RNA, 1410 nt, Artificial Sequence; identical to SEQ ID NO: 199752
  derived and/or modified sequence opt5 from neuraminidase__InfluenzaA__ACQ99628

SEQ ID NO: 199810 - RNA, 1410 nt, Artificial Sequence; identical to SEQ ID NO: 199752
  derived and/or modified sequence opt5 from neuraminidase__InfluenzaA__ACQ99629

SEQ ID NO: 199811 - RNA, 1410 nt, Artificial Sequence; identical to SEQ ID NO: 199752
  derived and/or modified sequence opt5 from neuraminidase__InfluenzaA__ACQ99630

SEQ ID NO: 199812 - RNA, 1410 nt, Artificial Sequence; identical to SEQ ID NO: 199762
  derived and/or modified sequence opt5 from neuraminidase__InfluenzaA__ACQ99632

SEQ ID NO: 199813 - RNA, 1410 nt, Artificial Sequence; identical to SEQ ID NO: 199762
  derived and/or modified sequence opt5 from neuraminidase__InfluenzaA__ACQ99633

SEQ ID NO: 199814 - RNA, 1410 nt, Artificial Sequence; identical to SEQ ID NO: 199752
  derived and/or modified sequence opt5 from neuraminidase__InfluenzaA__ACQ99635

SEQ ID NO: 199815 - RNA, 1410 nt, Artificial Sequence; identical to SEQ ID NO: 199752
  derived and/or modified sequence opt5 from neuraminidase__InfluenzaA__ACQ99636

SEQ ID NO: 199816 - RNA, 1410 nt, Artificial Sequence
  derived and/or modified sequence opt5 from neuraminidase__InfluenzaA__ACQ99684
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacgaacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucgugggaauuaaugagugguccggcuacucugggagcuucguccagcaucccgaacuuacaggccuggauuguauccgcccuugcuucuggguggagcucauuagaggacggcccaaagagaacacgaucuggaccuccggcagcucuauuuccuuuugugggguuaauagcgacacagugggauggucuuggcccgauggcgcugaacugccuuucaccaucgacaaguga

SEQ ID NO: 199817 - RNA, 1410 nt, Artificial Sequence
  derived and/or modified sequence opt5 from neuraminidase__InfluenzaA__ACQ99824
augaacaccaaucagagaaucauuacaaucggcacgauuugccugaucguggggauuaucagccuccugcuucaaaucggaaacauuauccugcucuggaugucccacucuauucagaccggcgaaaagagccaucccaaagucuguaaucaguccguuaucacauacgagaacaauaccugggugaaccagacauaugugaauauuucuaacaccaauaucgccgcugggcaaggagucacaccuauuauccuggccggcaacagcucccuuugcccgaucucugggugggcgauuuacagcaaggacaauuccauccggauuggaagcaaaggcgauaucuucgugaugcgcgagcccuuuauuucuuguucccaccuggaaugcagaaccuucuuucucacgcagggcgcucugcugaacgaccggcauagcaaugggaccguuaaggaucgcucuccuuauagaacacucauguccugucccaucggagaggccccuagccccuacaacucucgguucgaauccguggccuggagcgcuuccgccugccacgacggcaugggguggcugaccaucggaauuucuggcccugauaauggggcugucgccgugcuuaaauauaacggaaucauuacagacaccaucaagagcuggcgcaacaagauucugagaacgcaggaguccgaguguguuugcaucaauggcagcuguuuuacaaucaugaccgauggcccgucuaacgggcaggcguccuacaaacucuucaagauggaaaaaggaaagauuaucaaaagcauugagcuggacgcccccaauuaucauuacgaagagugcucuuguuacccugauacaggcaagguggucugcgugugccgggacaacuggcacgcuagcaaucgccccuggguguccuuugaucaaaaccuugacuaucagaucggguacauuuguucuggagucuucggcgauaauccuagaagcaacgacgggaagggaaauugcggccccguucuguccaacggcgccaauggggugaaaggauuuagcuuccgguauggcaacgggguguggaucggacgcaccaagucuauuuccagcagaucuggcuuugagaugaucugggacccgaauggguggaccgaaacagauuccagcuucuccaugaaacaggacaucauugcucucacggauuggucuggcuacagcggauccuuuguccagcacccugagcugaccggcaugaacuguauccggcccugcuucuggguggaacugauucgcgggcaaccuaaggagucuacaaucuggaccagcggauccagcauuucuuucuguggcguuaauuccgggacagccagcuggucuuggcccgacggagcggaucuccccuuuaccaucgacaaauga

SEQ ID NO: 199818 - RNA, 1410 nt, Artificial Sequence; identical to SEQ ID NO: 199762
  derived and/or modified sequence opt5 from neuraminidase__InfluenzaA__ACR01015

SEQ ID NO: 199819 - RNA, 1410 nt, Artificial Sequence; identical to SEQ ID NO: 199762
  derived and/or modified sequence opt5 from neuraminidase__InfluenzaA__ACR08422

SEQ ID NO: 199820 - RNA, 1410 nt, Artificial Sequence; identical to SEQ ID NO: 199762
  derived and/or modified sequence opt5 from neuraminidase__InfluenzaA__ACR08432

SEQ ID NO: 199821 - RNA, 1410 nt, Artificial Sequence; identical to SEQ ID NO: 199762
  derived and/or modified sequence opt5 from neuraminidase__InfluenzaA__ACR08442

SEQ ID NO: 199822 - RNA, 1410 nt, Artificial Sequence; identical to SEQ ID NO: 199762
  derived and/or modified sequence opt5 from neuraminidase__InfluenzaA__ACR08452

SEQ ID NO: 199823 - RNA, 1410 nt, Artificial Sequence
  derived and/or modified sequence opt5 from neuraminidase__InfluenzaA__ACR08462
augagccccaaccagaagaucauuaccaucggcuccgugugcaugacaauugggauggccaaucugauccuccaaauuggaaacaucaucucuauuuggaucagccacuccauucagcugggcaaucagaaccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccgugagaaucgggagcaaaggagaugucuuugugauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggagguuccuagccccuacaacucccgcuuugaaucuguggccuggagcgcuuccgccugccacgacggaaucaacuggcugaccauuggcaucagcgggccugauaauggagcugucgccgugcugaaguauaacggcaucauuacagacaccaucaagucuuggagaaauaacauucuccggacacaagaguccgagugugcgugcgugaaugggagcuguuucaccgucaugacggauggaccgucuaacggccaggccagcuacaaaaucuuucgcauugaaaagggcaaaaucguuaaguccguggagaugaaugcucccaacuaucauuacgaagagugcucuuguuacccugacagcuccgagaucacaugcgugugcagagauaauuggcacgggagcaaccggcccugggucucuuucaaucagaaccuggaauaucagauuggauacaucuguuccggcauuuuuggggacaauccucgccccaacgauaaaaccggaagcugcggcccggugucuuccaauggggccaacggaguuaagggcuucagcuuuaaguauggcaacgggguguggaucggaagaacaaaauccauuucuagccggaauggcuucgagaugaucugggacccuaacggguggaccggaaccgauaauaacuuuuccauuaagcaagacaucgucggcaucaaugaauggucuggguacagcggcuccuucgugcagcaucccgagcuuacaggacuggacuguauucgcccuugcuucuggguugaacucaucagaggccggcccaaagagaacacgauuuggaccagcgggucuuccaucagcuuuuguggagucaauucugauacagugggcugguccuggcccgacggggcugagcugccuuucaccauugauaaguga

SEQ ID NO: 199824 - RNA, 1410 nt, Artificial Sequence
  derived and/or modified sequence opt5 from neuraminidase__InfluenzaA__ACR08565
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucccugugaaacuugcgggaaauuccucucugugcccgguuagcggcugggcuauuuacuccaaggacaacagcgugagaaucgggucuaaaggagaugucuuugugauccgggagcccuucauuuccuguagcccucucgaaugccgcaccuuuuuccugacacagggcgcccuucugaaugacaagcauucuaacggcaccaucaaagauagaucccccuaucggacgcucaugagcuguccuauuggggagguucccucuccuuacaacucccgcuuugaaagcguggccugguccgcuucugccugccacgacggaaucaauuggcugaccauuggcaucagcgggccggauaacggagcugucgccgugcugaaguauaauggcaucauuacagacaccaucaaguccuggagaaacaauauucuccggacacaagagagcgagugugcgugcgugaacgggucuuguuucaccgucaugacggauggacccuccaauggccaggccagcuacaaaaucuuucgcauugaaaagggcaaaaucguuaagucuguggagaugaacgcuccuaauuaucauuacgaagagugcagcuguuaccccgacuccucugagaucacaugcgugugcagagauaacuggcacgggagcaaucggccuugggucuccuucaaccagaaucuggaauaucagauuggauacaucuguagcggcauuuuuggggacaacccccgcccgaaugauaaaaccggaucuugcggcccuguguccagcaacggggccaacggaguuaagggcuucucuuuuaaguauggcaaugggguguggaucggaagaacaaaauccauuagcucccggaacggcuucgagaugaucugggaccccaauggguggaccggaaccgauaacaauuuuucuauuaagcaagacaucgucggcaucaacgaauggagcggguacuccggcucuuucgugcagcauccugagcuuacaggacuggacuguauucgccccugcuucuggguugaacucaucagaggccggcccaaagagaauacgauuuggaccagcggguccagcaucucuuuuuguggagugaacuccgauacagucggcuggagcuggccugacggggcugagcugccguucaccauugauaaguga

SEQ ID NO: 199825 - RNA, 1410 nt, Artificial Sequence; identical to SEQ ID NO: 199752
  derived and/or modified sequence opt5 from neuraminidase__InfluenzaA__ACR08566

SEQ ID NO: 199826 - RNA, 1410 nt, Artificial Sequence; identical to SEQ ID NO: 199762
  derived and/or modified sequence opt5 from neuraminidase__InfluenzaA__ACR08567

SEQ ID NO: 199827 - RNA, 1410 nt, Artificial Sequence; identical to SEQ ID NO: 199752
  derived and/or modified sequence opt5 from neuraminidase__InfluenzaA__ACR08568

SEQ ID NO: 199828 - RNA, 1410 nt, Artificial Sequence; identical to SEQ ID NO: 199752
  derived and/or modified sequence opt5 from neuraminidase__InfluenzaA__ACR08569

SEQ ID NO: 199829 - RNA, 1410 nt, Artificial Sequence; identical to SEQ ID NO: 199762
  derived and/or modified sequence opt5 from neuraminidase__InfluenzaA__ACR08570

SEQ ID NO: 199830 - RNA, 1410 nt, Artificial Sequence; identical to SEQ ID NO: 199752
  derived and/or modified sequence opt5 from neuraminidase__InfluenzaA__ACR08571

SEQ ID NO: 199831 - RNA, 1410 nt, Artificial Sequence; identical to SEQ ID NO: 199752
  derived and/or modified sequence opt5 from neuraminidase__InfluenzaA__ACR08572

SEQ ID NO: 199832 - RNA, 1410 nt, Artificial Sequence; identical to SEQ ID NO: 199752
  derived and/or modified sequence opt5 from neuraminidase__InfluenzaA__ACR08573

SEQ ID NO: 199833 - RNA, 1410 nt, Artificial Sequence; identical to SEQ ID NO: 199752
  derived and/or modified sequence opt5 from neuraminidase__InfluenzaA__ACR08574

SEQ ID NO: 199834 - RNA, 1410 nt, Artificial Sequence; identical to SEQ ID NO: 199762
  derived and/or modified sequence opt5 from neuraminidase__InfluenzaA__ACR08576

SEQ ID NO: 199835 - RNA, 1410 nt, Artificial Sequence; identical to SEQ ID NO: 199752
  derived and/or modified sequence opt5 from neuraminidase__InfluenzaA__ACR08577

SEQ ID NO: 199836 - RNA, 1410 nt, Artificial Sequence; identical to SEQ ID NO: 199752
  derived and/or modified sequence opt5 from neuraminidase__InfluenzaA__ACR09378

SEQ ID NO: 199837 - RNA, 1410 nt, Artificial Sequence; identical to SEQ ID NO: 199752
  derived and/or modified sequence opt5 from neuraminidase__InfluenzaA__ACR09379

SEQ ID NO: 199838 - RNA, 1410 nt, Artificial Sequence; identical to SEQ ID NO: 199762
  derived and/or modified sequence opt5 from neuraminidase__InfluenzaA__ACR09380

SEQ ID NO: 199839 - RNA, 1410 nt, Artificial Sequence; identical to SEQ ID NO: 199752
  derived and/or modified sequence opt5 from neuraminidase__InfluenzaA__ACR09381

SEQ ID NO: 199840 - RNA, 1410 nt, Artificial Sequence; identical to SEQ ID NO: 199752
  derived and/or modified sequence opt5 from neuraminidase__InfluenzaA__ACR09382

SEQ ID NO: 199841 - RNA, 1410 nt, Artificial Sequence; identical to SEQ ID NO: 199762
  derived and/or modified sequence opt5 from neuraminidase__InfluenzaA__ACR09383

SEQ ID NO: 199842 - RNA, 1410 nt, Artificial Sequence; identical to SEQ ID NO: 199752
  derived and/or modified sequence opt5 from neuraminidase__InfluenzaA__ACR09384

SEQ ID NO: 199843 - RNA, 1410 nt, Artificial Sequence; identical to SEQ ID NO: 199762
  derived and/or modified sequence opt5 from neuraminidase__InfluenzaA__ACR09385

SEQ ID NO: 199844 - RNA, 1410 nt, Artificial Sequence; identical to SEQ ID NO: 199752
  derived and/or modified sequence opt5 from neuraminidase__InfluenzaA__ACR09386

SEQ ID NO: 199845 - RNA, 1410 nt, Artificial Sequence; identical to SEQ ID NO: 199762
  derived and/or modified sequence opt5 from neuraminidase__InfluenzaA__ACR10189

SEQ ID NO: 199846 - RNA, 1410 nt, Artificial Sequence; identical to SEQ ID NO: 199762
  derived and/or modified sequence opt5 from neuraminidase__InfluenzaA__ACR10226

SEQ ID NO: 199847 - RNA, 1410 nt, Artificial Sequence; identical to SEQ ID NO: 199752
  derived and/or modified sequence opt5 from neuraminidase__InfluenzaA__ACR10236

SEQ ID NO: 199848 - RNA, 1410 nt, Artificial Sequence; identical to SEQ ID NO: 199752
  derived and/or modified sequence opt5 from neuraminidase__InfluenzaA__ACR10237

SEQ ID NO: 199849 - RNA, 1410 nt, Artificial Sequence
  derived and/or modified sequence opt5 from neuraminidase__InfluenzaA__ACR15186
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaagugguccaaaccccaguguaauauuaccggguucgccccuuuuucuaaggacaacagcauccgccuguccgcgggaggcgauaucugggugacaagagagcccuaugucucuugcgacccugauaaguguuaccaauucgcucuugggcagggaaccacacugaauaacgugcauagcaaugacaccguucgggaucgcacgccguauagaacacuccugaugaacgaacugggcgugcccuuucaccucgggaccaaacaggucugcauugccugguccucuagcuccugucaugacggaaaggccuggcugcacgugugcguuacaggcgaugacaaaaaugcuaccgccagcuucaucuacaacggccggcuuguggauucuauugucuccuggagcaaggagauccugcgcacccaggaaucugagugugugugcauuaaugggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccuagacaccccggcgugcggugugucugccgcgacaacuggagagggagcaaccggccuaucguggauauuaauaugaaagacuacucuaucguuuccagcuacguguguucuggacuugucggcgacacgccccgcaagaacgauagcuccucuagcggccauugccuggacccgaauaacgaggaagggggacacggcgugaaagggugggccuucgaugacggaaaugauguuuggaugggcagaaccauuuccgagaagcuccggagcggguaugagacauuuaaagugaucgaaggauggucuaacccuaauuccaagcugcagaucaaccgccaggucauuguggacagaggcaaucggagcggcuacucugggaucuucuccgucgagggaaaaagcuguauuaacagaugcuuuuauguggaacugauccgcggccggaaggaggaaaccgagguucucuggaccuccaauucuauuguggucuucugugggacaagcggaaccuacggcacaggguccuggcccgauggcgcugacaucaaccugaugccuauuuga

SEQ ID NO: 199850 - RNA, 1413 nt, Artificial Sequence; identical to SEQ ID NO: 199656
  derived and/or modified sequence opt5 from neuraminidase__InfluenzaA__ACR15197

SEQ ID NO: 199851 - RNA, 1410 nt, Artificial Sequence
  derived and/or modified sequence opt5 from neuraminidase__InfluenzaA__ACR15208
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuaucguguccuggagcaaagagauucugcgcacccaggaaucugagugugucugcaucaaugggacauguacgguggugaugaccgauggauccgcuagcggcaaggccgacacaaaaauccucuuuauugaggaagggaagaucguccauaccuccacacugucuggaagcgcgcaacacguugaggaaugcuccugcuauccuagauaccccggcgugcggugugugugccgcgauaacuggaaggggagcaacagaccuauugucgacaucaauauuaaagaccacucuaucguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcaccaucagcgagaagucuagacucggcuaugagacauuuaaaguuauugaagggugguccaacccuaagagcaaacugcagaucaaucgccaggugauugucgauaagggaaaccggucuggcuacuccggcaucuucagcguggaggggaaguccuguauuaauagaugcuuuuaugucgaacugauccggggaagaaaagaggaaaccgaggugcucuggaccucuaacagcauuguuguguucuguggcacauccgggaccuacggaacaggcucuuggcccgacggggcugauaucaaucugaugccuaucuga

SEQ ID NO: 199852 - RNA, 1410 nt, Artificial Sequence
  derived and/or modified sequence opt5 from neuraminidase__InfluenzaA__ACR15230
auggaccccaaccagaagaucauuaccaucggcagcgugucccugacaauuucugccaucugcuucuuuaugcaaauugcuauccucaucacgaccgucacacugcacuucaaacaguacgaguuuaauagcccuccgaacaaucagguuaugcuuugugaacccaccauuaucgagagaaacauuacagaaaucguguaucugaccaauacaaccauugagaaggaaaucugcccuaaacucgccgaguaccggaacugguccaagccccaguguaauauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaaugauacaguucacgaccggaccccguaucgcacgcuccugaugaacgaacugggcgugcccuuucaucucgggacaaagcaggucugcauugccugguccucuagcuccugucacgauggaaaagccuggcugcaugugugcguuaccggcgacgaugagaaugcuacagcuagcuucaucuacaacggcagacuuguggacucugucguguccuggagcaagaaaauucugcggacccaggaaucugagugugugugcaucaaugggaccuguacagucguuaugacggauggauccgccagcggcaaggcggacaccaaaauucucuuuaucgaggaagggaagaucgugcacacauccacccugucuggaagcgcccaacacguggaggaaugcuccugcuauccucgcuaccccggcgucagaugugugugccgggauaacuggaaggggagcaaccgcccuauuguugacaucaauauuaaagacuacucuaucguguccagcuaugucuguucuggacuugugggcgauacacccagaaagaacgacagcuccucuaauagccauugccuggauccgaacaaugaggaaggcgggcacggaguuaaaggcugggcuuucgacgaugggaacgacguguggaugggacggaccauuuccgagaagcuccgcagcggcuacgagacguuuaaagucaucgaaggguggucuaauccuaacuccaagcugcagaucaauagacaggugauugucgaucggggaaaccgcagcggcuauucuggcaucuucuccguggaggggaaaagcuguauuaauagaugcuuuuacguugaacugauccggggaagaaaccaggagacagaagugcucuggaccuccaauucuauugucguguucuguggcaccagcgggacauauggaaccggcuccuggcccgacggggccgauaucaaccugaugccuauuuga

SEQ ID NO: 199853 - RNA, 1413 nt, Artificial Sequence; identical to SEQ ID NO: 199656
  derived and/or modified sequence opt5 from neuraminidase__InfluenzaA__ACR15241

SEQ ID NO: 199854 - RNA, 1410 nt, Artificial Sequence; identical to SEQ ID NO: 198908
  derived and/or modified sequence opt5 from neuraminidase__InfluenzaA__ACR15252

SEQ ID NO: 199855 - RNA, 1413 nt, Artificial Sequence
  derived and/or modified sequence opt5 from neuraminidase__InfluenzaA__ACR15263
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccgaggacggagaaggcucuuguaauccuguuaccguggauggcgccaacggggugaaaggauucuccuacaaguaugacaauggcgucuggaucgggcggacaaaaagcaaccgccugagaaagggauuugagaugauuugggaccccaauggcuggacgaacaccgauucugacuucuccgugaaacaggauguuguggcgaucacagacuggagcggguacuccggcucuuuuguccagcacccggaacucaccggacuggauugcauccggccuuguuucuggguggagcuuguucgcggccugcccagagaaaacacaaccauuuggagcuccgggucuagcaucuccuucugcggagugaauagcgacacggccaacuggucuuggccugauggcgcugagcuccccuuuacaauugacaaguga

SEQ ID NO: 199856 - RNA, 1413 nt, Artificial Sequence; identical to SEQ ID NO: 199656
  derived and/or modified sequence opt5 from neuraminidase__InfluenzaA__ACR15274

SEQ ID NO: 199857 - RNA, 1413 nt, Artificial Sequence
  derived and/or modified sequence opt5 from neuraminidase__InfluenzaA__ACR15307
augaaccccaaucagaagaucauuaccaucggcagcauuuccaucacaauugggaucaucucucugaugcuccaaauuggaaacaucauuagcaucugggccucccacucuauucagacgggcagccagaaucauaccgggaucugcaaccagagaauuaucacauacgagaauaacaccugggugaaucacacauaugucaacaucaauaacaccaauguuguggcuggaaaagacaagacauccgugacccuggccggcaacucuagccuuuguuccauuagcgggugggcgaucuacacgaaagauaauucuauucggaucggauccaagggcgacgucuucgugauucgcgaaccuuuuaucagcugcucucaucuggaguguagaaccuucuuucucacacaaggcgcucugcuuaacgauaaacacuccaaugggaccguuaaggaccggagcccguaucgcgcccugaugucuugcccccucggagaagccccuucccccuacaacagcaaguucgaguccguggcuuggucugccagcgcuugucaugauggcaugggguggcugacaaucggaauuuccggcccugacaacggggccgucgcggugcugaaauauaauggaaucauuaccgaaacgaucaagagcuggaaaaagcggauucucagaacacaggagucugagugcguuugugugaacggcuccugcuuuaccaucaugacagauggccccagcaauggggccgcuucuuacaaaaucuucaagauugaaaagggaaaagucaccaagagcaucgagcugaacgccccuaauuuucacuaugaagaguguuccugcuacccggacaccggcacagugaugugugugugccgcgauaacuggcacgggucuaauagacccugggucagcuucaaccagaaucuugacuaccagauuggauauaucugcuccggcguuuuuggggauaacccucggcccaaagacggagagggcagcuguaauccugugacgguggauggcgcugacggggucaagggauucucuuacaaauauggcaacgggguguggauuggacgcaccaaguccaauagacugcggaaaggcuuugaaaugaucugggaccccaacggguggacagauaccgacagcgauuucucuguuaagcaagacguggucgccauuacagauugguccggcuacagcggauccuuugugcagcauccggagcucaccggccuggacugcauccgcccuuguuucuggguugaacuugugagagggcugccccgggagaauacgacaaucuggaccucuggaagcuccauuucuuucugcggcgucaacagcgauaccgcgaacugguccuggccugacggggccgaacuccccuuuacaaucgauaaguga

SEQ ID NO: 199858 - RNA, 1413 nt, Artificial Sequence
  derived and/or modified sequence opt5 from neuraminidase__InfluenzaA__ACR15318
augaaccccaaucagaagaucauuaccaucggcagcauuuccaucgccauugggaucaucucucugaugcuccaaauuggaaacaucauuagcaucugggcuucccacucuauucagacaggcagccagaaucauacgggggugugcaaccagagaaucauuaccuacgaaaauuccacaugggucaaccacaccuauguuaauaucaacaauacaaacgugaucgccggaaaagacaagaccucugugacacuggcgggcaauagcucccuuuguagcauuucugggugggcuaucuacaccaaagauaacuccauucggaucggaagcaagggcgacgucuucgugauucgcgagccuuuuaucucuugcucccaucuggaguguagaacguucuuucucacccaaggcgcccugcuuaaugauaaacacagcaacgggacaguuaaggaccggucuccguaucgcgcccugauguccugcccccucggagaagcuccuagccccuacaauuccaaguucgagucuguggccuggagcgcuuccgccugucaugauggcaugggguggcugaccaucggaauuagcggcccugacaacggggcggucgccgugcugaaauauaacggaaucauuacagaaaccaucaagucuuggaaaagacagauucuccggacgcaggaguccgagugcguuugugugaauggcagcugcuuuacaaucaugaccgauggccccucuaacggggcugccagcuacaagaucuucaaaauugaaaagggaaaggucacaaaauccaucgagcugaaugcuccuaacuuucacuaugaagaguguucuugcuacccggacaccggcaccgugaugugugugugccgcgauaauuggcacgggagcaacagacccugggucuccuucaaucagaaccuugacuaccaaauuggauauaucugcagcggcguuuuuggggauaauccucggcccaaggacggagagggcucuuguaacccugugacaguggauggcgccaauggggucaaaggauucuccuacaaguauggcaacgggguguggauuggacgcacgaaaagcaauagacugcggaagggcuuugaaaugaucugggaccccaacggguggaccgacacagauucugacuucuccguuaaacaggauguggucgcgauuaccgacuggagcggcuacuccggaucuuuugugcagcauccggagcucacaggccuggauugcauccgcccuuguuucuggguugaacuugugagagggcugcccaaggagaauaccacgaucuggacaagcggauccucuauuagcuucugcggcgucaacuccgacaccgccaacuggagcuggccugauggggcugaacuccccuuuaccaucgacaaguga

SEQ ID NO: 199859 - RNA, 1413 nt, Artificial Sequence
  derived and/or modified sequence opt5 from neuraminidase__InfluenzaA__ACR15329
augaaccccaaucagaagaucauuaccaucggcagcauuuccaucgccauugggaucaucucucugaugcuccaaauuggaaacaucauuagcaucugggcuucccacucuauucagacaagaagccagaaucauacgggcgugugcaaccagcggaucauuaccuacgagaauagcacaugggucaaccacaccuauguuaauaucaacaauacaaacgugaucgccgggaaagacaagaccucugugacacuggcgggaaauagcucccuuuguagcauuucuggcugggcuaucuacaccaaagauaacuccauucgcaucgggagcaagggagacgucuucgugauuagagaaccuuuuaucucuugcucccaucuggagugucggacguucuuucucacccaaggcgcccugcuuaaugauaaacacagcaacggcacaguuaaggaccgcucuccguauagagcccugauguccugcccccucggggaagcuccuagccccuacaauuccaaguucgagucuguggccuggagcgcuuccgccugucaugauggaaugggcuggcugaccaucgggauuagcggaccugacaacggcgcggucgccgugcugaaauauaacgggaucauuacagaaaccaucaagucuuggaaaaagcagauucuccggacgcaggaguccgagugcguuugugugaauggaagcugcuuuacaaucaugaccgauggccccucuaacggcgcugccagcuacaaaaucuucaagauugaaaaggggaaagucacaaaguccaucgagcugaaugcuccuaacuuucacuaugaagaguguucuugcuacccggacaccggaaccgugaugugugugugccgcgauaauuggcacggcagcaacagacccugggucuccuucaaucagaaccuugacuaccaaauuggguauaucugcagcggaguuuuuggcgauaauccucggcccaaagacggggagggaucuuguaacccugugacaguggauggcgccaauggcgucaagggguucuccuacaaauauggaaacggcguguggauugggcgcacgaaguccaauagacugcggaaaggauuugaaaugaucugggaccccaacggcuggaccgacacagauucugacuucuccguuaagcaggauguggucgcgauuaccgacuggagcggguacuccggcucuuuugugcagcauccggagcucacaggacuggauugcauccgcccuuguuucuggguugaacuugugagaggccugcccaaggagaauaccacgaucuggacaagcggguccucuauuagcuucugcggagucaacuccgacaccgccaacuggagcuggccugauggcgcugaacuccccuuuaccaucgacaaauga

SEQ ID NO: 199860 - RNA, 1413 nt, Artificial Sequence; identical to SEQ ID NO: 199656
  derived and/or modified sequence opt5 from neuraminidase__InfluenzaA__ACR15340

SEQ ID NO: 199861 - RNA, 1413 nt, Artificial Sequence; identical to SEQ ID NO: 199656
  derived and/or modified sequence opt5 from neuraminidase__InfluenzaA__ACR15362

SEQ ID NO: 199862 - RNA, 1413 nt, Artificial Sequence; identical to SEQ ID NO: 199656
  derived and/or modified sequence opt5 from neuraminidase__InfluenzaA__ACR15373

SEQ ID NO: 199863 - RNA, 1413 nt, Artificial Sequence
  derived and/or modified sequence opt5 from neuraminidase__InfluenzaA__ACR15428
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcgucucugggugggcuauuuacaccaaggauaauuccauccggauuggaagcaaaggcgacguguucguuauccgcgagccuuuuauuucuugcucccaccuggaauguagaacguucuuucucaccaagggcgcccugcuuaacgauaaacauagcaaugggacagugaaggaccggucuccguaucgcgcccugauguccugcccccucggagaggcuccuagccccuacaacuccaaguucgaaucugucgccuggagcgcuuccgccugucacgauggcaugggguggcugaccaucggaaucagcggcccugacaacggggcgguggccguucugaaauauaauggaauuaucacaggcaccauuaagucuuggaaaaagcaaauccucagaacgcaggaguccgagugcguguguaugaacggcagcugcuuuacaauuaugaccgaugggcccucuaauaaagcugccagcuacaagaucuucaagaucgaaaaaggaaaggucacaaaauccauugagcugaacgcuccuaauuuucauuaugaagaguguucuugcuacccggacaccggcaucgugaugugugugugccgggauaacuggcacgggagcaaucgccccugggucuccuucaaccagaaucuugacuaccagauuggauauaucugcagcggcguuuuuggggauaacccuagacccgaggacggagaaggcucuuguaauccugugaccguggauggcgccaacggggucaagggauucuccuacaaauaugacaauggcguguggauugggcggacaaagagcaaccgccugagaaaaggauuugagaugaucugggaccccaauggcuggacgaacaccgauucugacuucuccguuaagcaagauguggucgcgauuacagacuggagcggguacuccggcucuuuugugcagcacccggaacucaccggacuggauugcauccggccuuguuucuggguugagcuugugcgcggccugcccagagaaaacacaaccaucuggacgagcggguccucuauuagcuucugcggagucaauuccgacacagccaacuggagcuggccugauggcgcugagcuccccuuuaccaucgacaaguga

SEQ ID NO: 199864 - RNA, 1413 nt, Artificial Sequence
  derived and/or modified sequence opt5 from neuraminidase__InfluenzaA__ACR15472
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccccugugacacuggcgggcaacucuagccuuuguuccauuagcgggugggcuaucuacaccaaggauaauucuauucggaucggauccaaaggcgacgucuucgugauucgcgagccguuuaucgccugcagccaccuggaauguagaacguucuuucucacccaaggcgcccugcuuaacgauaagcauucuaaugggacaguuaaagaccggucccccuaucgcgcucugaugagcugcccucucggagaggcccccucuccuuacaacuccaaguucgaaagcguggcuugguccgccucugcgugucacgauggcaugggguggcugaccaucggaauuagcggccccgacaacggggccgucgcugugcugaaguauaauggaaucauuacaggcaccaucaaauccuggaagaaacagauucucagaacgcaggagagcgagugcguuuguaugaacggcucuugcuuuacaaucaugaccgaugggccuuccaauaaggccgcuagcuacaaaaucuucaagauugaaaagggaaaagugacaaagucuaucgagcugaacgccccgaauuuucauuaugaagaguguagcugcuaccccgacaccggcauugucaugugugugugccgggauaacuggcacggguccaaucgcccuugggugucuuucaaccagaaucuugacuaccaaaucggauauauuugcagcggcgucuuuggggauaaccccagaccugaggacggagaaggcuccuguaaucccguuaccguggauggcgcgaacggggugaaaggauucagcuacaaguaugacaauggcgucuggaucgggcggacaaaaucuaaccgccugagaaagggauuugaggugauuugggacccgaauggcuggacgaacaccgauuccgacuucagcguuaaacaggauguggucgccaucacagacuggucuggguacuccggcagcuuugugcagcacccugaacucaccggacuggauugcauccggcccuguuucuggguugagcuugugcgcggccugccuagagaaaacacaaccauuuggacguccgggucuagcaucuccuucugcggagucaauucugacacagcuaacuggagcuggcccgauggcgccgagcuccccuuuaccauugacaaguga

SEQ ID NO: 199865 - RNA, 1413 nt, Artificial Sequence; identical to SEQ ID NO: 199656
  derived and/or modified sequence opt5 from neuraminidase__InfluenzaA__ACR15483

SEQ ID NO: 199866 - RNA, 1413 nt, Artificial Sequence; identical to SEQ ID NO: 199656
  derived and/or modified sequence opt5 from neuraminidase__InfluenzaA__ACR15505

SEQ ID NO: 199867 - RNA, 1413 nt, Artificial Sequence; identical to SEQ ID NO: 199740
  derived and/or modified sequence opt5 from neuraminidase__InfluenzaA__ACR15516

SEQ ID NO: 199868 - RNA, 1410 nt, Artificial Sequence; identical to SEQ ID NO: 197738
  derived and/or modified sequence opt5 from neuraminidase__InfluenzaA__ACR15527

SEQ ID NO: 199869 - RNA, 1410 nt, Artificial Sequence
  derived and/or modified sequence opt5 from neuraminidase__InfluenzaA__ACR15538
augauccccauucagaagaucauuaccaucggcagcgugucccugacaauuucuacgaucugcuucuuuaugcaaaucgccauucucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaaugauaccguucacgaccggacgccguaucgcacacuccugaugaacgaacugggcgugcccuuucaucucgggaccaagcaggucugcauugccugguccucuagcuccugucacgauggaaaagccuggcugcaugugugcguuacaggcgacgauaagaaugcuaccgccagcuucaucuacaacggcagacuuguggacucuauugucuccuggagcaaagagauccugcggacccaggaaucugagugugugugcaucaaugggacauguacgguggucaugaccgauggauccgcuagcggcaaggccgacacaaaaauucucuuuaucgaggaagggaagauuguucacaccuccacacugucuggaagcgcgcaacacguggaggaaugcuccugcuauccucgcuaccccggcgugagaugugucugccgggauaacuggaaggggagcaaucgcccuaucguggacauuaacaucaaagacuacucuaucguuuccagcuauguguguucuggacuugucggcgauacccccagaaagaacgacagcuccucuagcucccauugccuggauccgaauaacgaggaaggcgggcacggagugaaaggcugggccuucgacgaugggaaugacguuuggaugggacggacgauuagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauaucaaccugaugccuauuuga

SEQ ID NO: 199870 - RNA, 1410 nt, Artificial Sequence; identical to SEQ ID NO: 197351
  derived and/or modified sequence opt5 from neuraminidase__InfluenzaA__ACR15549

SEQ ID NO: 199871 - RNA, 1410 nt, Artificial Sequence; identical to SEQ ID NO: 197736
  derived and/or modified sequence opt5 from neuraminidase__InfluenzaA__ACR15560

SEQ ID NO: 199872 - RNA, 1410 nt, Artificial Sequence; identical to SEQ ID NO: 197736
  derived and/or modified sequence opt5 from neuraminidase__InfluenzaA__ACR15582

SEQ ID NO: 199873 - RNA, 1410 nt, Artificial Sequence
  derived and/or modified sequence opt5 from neuraminidase__InfluenzaA__ACR15593
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacaggcugaguaccggaauugguccaagccccaauguaacauuaccggguucgccccuuuuucuaaagacaauagcauccgccucuccgcgggaggcgauaucugggugacaagagagcccuaugucucuugcgacccugauaaguguuaccaguucgcucuggggcagggaaccacacuuaacaaugugcauagcaacgacaccguucacgaucggacgccguaucgcacacugcucaugaaugaacugggcgugcccuuucaucuggggaccaagcaggucugcauugccugguccucuagcuccugucacgacggaaaagccuggcuccaugugugcguuacaggcgaugacaagaacgcuaccgccagcuucaucuacaauggcagacugguggauucuauugucuccuggagcaaagagauccuucggacccaagaaucugagugugugugcauuaacgggacauguacgguggucaugaccgacggauccgcuagcggcaaggccgauacaaaaauccuguuuaucgaggaagggaagauuguucacaccuccacacucucuggaagcgcgcagcacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuggucggcgacacccccagaaagaaugauagcuccucuagcucccauugccuugacccgaacaaugaggaaggcgggcacggagugaaaggcugggccuucgaugacgggaacgauguuuggaugggacggacgaucagcgagaagcugcgcucuggcuacgagacauuuaaagugaucgaagggugguccaauccuaacagcaagcuccagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucuguggaccucuaacagcaucguggucuucuguggcacauccgggaccuauggaacaggcucuuggcccgauggggcugacauuaaucucaugccuaucuga

SEQ ID NO: 199874 - RNA, 1410 nt, Artificial Sequence
  derived and/or modified sequence opt5 from neuraminidase__InfluenzaA__ACR15604
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaagcugcagauuaauagacaggucaucguggaccggggagaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 199875 - RNA, 1410 nt, Artificial Sequence; identical to SEQ ID NO: 199752
  derived and/or modified sequence opt5 from neuraminidase__InfluenzaA__ACR15618

SEQ ID NO: 199876 - RNA, 1410 nt, Artificial Sequence; identical to SEQ ID NO: 199752
  derived and/or modified sequence opt5 from neuraminidase__InfluenzaA__ACR18924

SEQ ID NO: 199877 - RNA, 1410 nt, Artificial Sequence; identical to SEQ ID NO: 199752
  derived and/or modified sequence opt5 from neuraminidase__InfluenzaA__ACR18925

SEQ ID NO: 199878 - RNA, 1410 nt, Artificial Sequence; identical to SEQ ID NO: 199762
  derived and/or modified sequence opt5 from neuraminidase__InfluenzaA__ACR18926

SEQ ID NO: 199879 - RNA, 1410 nt, Artificial Sequence; identical to SEQ ID NO: 199762
  derived and/or modified sequence opt5 from neuraminidase__InfluenzaA__ACR18927

SEQ ID NO: 199880 - RNA, 1410 nt, Artificial Sequence; identical to SEQ ID NO: 199762
  derived and/or modified sequence opt5 from neuraminidase__InfluenzaA__ACR18928

SEQ ID NO: 199881 - RNA, 1410 nt, Artificial Sequence; identical to SEQ ID NO: 199762
  derived and/or modified sequence opt5 from neuraminidase__InfluenzaA__ACR18929

SEQ ID NO: 199882 - RNA, 1410 nt, Artificial Sequence; identical to SEQ ID NO: 199762
  derived and/or modified sequence opt5 from neuraminidase__InfluenzaA__ACR18930

SEQ ID NO: 199883 - RNA, 1410 nt, Artificial Sequence; identical to SEQ ID NO: 199762
  derived and/or modified sequence opt5 from neuraminidase__InfluenzaA__ACR18931

SEQ ID NO: 199884 - RNA, 1410 nt, Artificial Sequence; identical to SEQ ID NO: 199762
  derived and/or modified sequence opt5 from neuraminidase__InfluenzaA__ACR18933

SEQ ID NO: 199885 - RNA, 1410 nt, Artificial Sequence; identical to SEQ ID NO: 199752
  derived and/or modified sequence opt5 from neuraminidase__InfluenzaA__ACR18934

SEQ ID NO: 199886 - RNA, 1410 nt, Artificial Sequence; identical to SEQ ID NO: 199762
  derived and/or modified sequence opt5 from neuraminidase__InfluenzaA__ACR18935

SEQ ID NO: 199887 - RNA, 1410 nt, Artificial Sequence; identical to SEQ ID NO: 199762
  derived and/or modified sequence opt5 from neuraminidase__InfluenzaA__ACR23301

SEQ ID NO: 199888 - RNA, 1410 nt, Artificial Sequence; identical to SEQ ID NO: 199762
  derived and/or modified sequence opt5 from neuraminidase__InfluenzaA__ACR32997

SEQ ID NO: 199889 - RNA, 1410 nt, Artificial Sequence
  derived and/or modified sequence opt5 from neuraminidase__InfluenzaA__ACR33740
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcggcacagugggguggucuuggcccgacggagcugagcugccuuucaccaucgauaaguga

SEQ ID NO: 199890 - RNA, 1410 nt, Artificial Sequence; identical to SEQ ID NO: 199752
  derived and/or modified sequence opt5 from neuraminidase__InfluenzaA__ACR38792

SEQ ID NO: 199891 - RNA, 1410 nt, Artificial Sequence; identical to SEQ ID NO: 199762
  derived and/or modified sequence opt5 from neuraminidase__InfluenzaA__ACR38793

SEQ ID NO: 199892 - RNA, 1410 nt, Artificial Sequence; identical to SEQ ID NO: 199762
  derived and/or modified sequence opt5 from neuraminidase__InfluenzaA__ACR38794

SEQ ID NO: 199893 - RNA, 1410 nt, Artificial Sequence; identical to SEQ ID NO: 199762
  derived and/or modified sequence opt5 from neuraminidase__InfluenzaA__ACR38878

SEQ ID NO: 199894 - RNA, 1410 nt, Artificial Sequence; identical to SEQ ID NO: 199762
  derived and/or modified sequence opt5 from neuraminidase__InfluenzaA__ACR39357

SEQ ID NO: 199895 - RNA, 1410 nt, Artificial Sequence; identical to SEQ ID NO: 199762
  derived and/or modified sequence opt5 from neuraminidase__InfluenzaA__ACR39396

SEQ ID NO: 199896 - RNA, 1410 nt, Artificial Sequence; identical to SEQ ID NO: 199762
  derived and/or modified sequence opt5 from neuraminidase__InfluenzaA__ACR39406

SEQ ID NO: 199897 - RNA, 1410 nt, Artificial Sequence; identical to SEQ ID NO: 199762
  derived and/or modified sequence opt5 from neuraminidase__InfluenzaA__ACR39416

SEQ ID NO: 199898 - RNA, 1410 nt, Artificial Sequence; identical to SEQ ID NO: 199762
  derived and/or modified sequence opt5 from neuraminidase__InfluenzaA__ACR39426

SEQ ID NO: 199899 - RNA, 1410 nt, Artificial Sequence; identical to SEQ ID NO: 199762
  derived and/or modified sequence opt5 from neuraminidase__InfluenzaA__ACR39436

SEQ ID NO: 199900 - RNA, 1410 nt, Artificial Sequence; identical to SEQ ID NO: 199762
  derived and/or modified sequence opt5 from neuraminidase__InfluenzaA__ACR39446

SEQ ID NO: 199901 - RNA, 1410 nt, Artificial Sequence; identical to SEQ ID NO: 199762
  derived and/or modified sequence opt5 from neuraminidase__InfluenzaA__ACR39456

SEQ ID NO: 199902 - RNA, 1410 nt, Artificial Sequence; identical to SEQ ID NO: 199762
  derived and/or modified sequence opt5 from neuraminidase__InfluenzaA__ACR39466

SEQ ID NO: 199903 - RNA, 1410 nt, Artificial Sequence; identical to SEQ ID NO: 199762
  derived and/or modified sequence opt5 from neuraminidase__InfluenzaA__ACR39476

SEQ ID NO: 199904 - RNA, 1410 nt, Artificial Sequence; identical to SEQ ID NO: 199762
  derived and/or modified sequence opt5 from neuraminidase__InfluenzaA__ACR39486

SEQ ID NO: 199905 - RNA, 1410 nt, Artificial Sequence; identical to SEQ ID NO: 199762
  derived and/or modified sequence opt5 from neuraminidase__InfluenzaA__ACR39496

SEQ ID NO: 199906 - RNA, 1410 nt, Artificial Sequence; identical to SEQ ID NO: 199762
  derived and/or modified sequence opt5 from neuraminidase__InfluenzaA__ACR40291

SEQ ID NO: 199907 - RNA, 1410 nt, Artificial Sequence; identical to SEQ ID NO: 199762
  derived and/or modified sequence opt5 from neuraminidase__InfluenzaA__ACR40301

SEQ ID NO: 199908 - RNA, 1410 nt, Artificial Sequence
  derived and/or modified sequence opt5 from neuraminidase__InfluenzaA__ACR40311
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucugugagaauuggguccaaaggagaugucuuugugauccgggagccguucaucagcuguucuccccucgaaugccgcacauuuuuccugacccagggcgcccuucugaaugacaagcauuccaacggcacgauuaaagauagaagcccuuaucggacccucaugucuugucccaucggggagguuccuucccccuacaacagccgcuuugaauccguggccuggucugcuagcgccugccacgacggaauuaauuggcugacaaucggcauuuccgggccugauaacggagcugucgccgugcugaaguauaauggcaucaucaccgacacaauuaagagcuggagaaacaauauccuccggacccaagagucugagugugcgugcgugaacggguccuguuucacggucaugacagauggaccgagcaauggccaggccucuuacaaaauuuuucgcaucgaaaagggcaaaauuguuaagagcguggagaugaacgcucccaauuaucauuacgaagagugcuccuguuacccugacucuagcgagauuaccugcgugugcagagauaacuggcacggguccaaucggcccugggucagcuucaaccagaaucuggaauaucagaucggauacaucuguucuggcaucuuuggggacaacccucgccccaaugauaaaacaggauccugcggcccggugagcucuaacggggccaacggaguuaagggcuucuccuuuaaguauggcaaugggguguggauuggaagaaccaaaagcaucuccucucggaacggcuucgagaugauuugggacccuaauggguggaccggaacagauaacaauuuuagcaucaagcaagacauugucggcaucaacgaaugguccggguacucuggcagcuucgugcagcaucccgagcuuacgggacuggacuguauccgcccuugcuucuggguugaacucauuagaggccggcccaaagagaauaccaucuggacauccgggagcucuauuuccuuuuguggagugaacagcgauaccgucggcuggucuuggcccgacggggcugagcugccuuucacaaucgauaaguga

SEQ ID NO: 199909 - RNA, 1410 nt, Artificial Sequence
  derived and/or modified sequence opt5 from neuraminidase__InfluenzaA__ACR40321
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaauggaaccgacaacaauuuuagcaucaagcaagacaucgugggcauuaacgaaugguccggguacucuggcagcuucguccagcaucccgagcuuaccggacuggauuguauccgcccuugcuucuggguggaacucauuagaggccggcccaaagagaauacaaucuggacguccgggagcucuauuuccuuuuguggaguuaacagcgacaccgugggcuggucuuggcccgauggggcugagcugccuuucacaaucgacaaguga

SEQ ID NO: 199910 - RNA, 1410 nt, Artificial Sequence; identical to SEQ ID NO: 199762
  derived and/or modified sequence opt5 from neuraminidase__InfluenzaA__ACR40341

SEQ ID NO: 199911 - RNA, 1410 nt, Artificial Sequence; identical to SEQ ID NO: 199762
  derived and/or modified sequence opt5 from neuraminidase__InfluenzaA__ACR40351

SEQ ID NO: 199912 - RNA, 1410 nt, Artificial Sequence; identical to SEQ ID NO: 199762
  derived and/or modified sequence opt5 from neuraminidase__InfluenzaA__ACR40361

SEQ ID NO: 199913 - RNA, 1410 nt, Artificial Sequence; identical to SEQ ID NO: 199762
  derived and/or modified sequence opt5 from neuraminidase__InfluenzaA__ACR40371

SEQ ID NO: 199914 - RNA, 1410 nt, Artificial Sequence; identical to SEQ ID NO: 199762
  derived and/or modified sequence opt5 from neuraminidase__InfluenzaA__ACR40391

SEQ ID NO: 199915 - RNA, 1410 nt, Artificial Sequence; identical to SEQ ID NO: 199752
  derived and/or modified sequence opt5 from neuraminidase__InfluenzaA__ACR46663

SEQ ID NO: 199916 - RNA, 1410 nt, Artificial Sequence; identical to SEQ ID NO: 199752
  derived and/or modified sequence opt5 from neuraminidase__InfluenzaA__ACR46673

SEQ ID NO: 199917 - RNA, 1410 nt, Artificial Sequence
  derived and/or modified sequence opt5 from neuraminidase__InfluenzaA__ACR46996
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 199918 - RNA, 1410 nt, Artificial Sequence; identical to SEQ ID NO: 199917
  derived and/or modified sequence opt5 from neuraminidase__InfluenzaA__ACR46997

SEQ ID NO: 199919 - RNA, 1410 nt, Artificial Sequence; identical to SEQ ID NO: 199917
  derived and/or modified sequence opt5 from neuraminidase__InfluenzaA__ACR46998

SEQ ID NO: 199920 - RNA, 1410 nt, Artificial Sequence; identical to SEQ ID NO: 199917
  derived and/or modified sequence opt5 from neuraminidase__InfluenzaA__ACR46999

SEQ ID NO: 199921 - RNA, 1410 nt, Artificial Sequence; identical to SEQ ID NO: 199917
  derived and/or modified sequence opt5 from neuraminidase__InfluenzaA__ACR47000

SEQ ID NO: 199922 - RNA, 1410 nt, Artificial Sequence; identical to SEQ ID NO: 199917
  derived and/or modified sequence opt5 from neuraminidase__InfluenzaA__ACR47001

SEQ ID NO: 199923 - RNA, 1410 nt, Artificial Sequence; identical to SEQ ID NO: 199917
  derived and/or modified sequence opt5 from neuraminidase__InfluenzaA__ACR47002

SEQ ID NO: 199924 - RNA, 1410 nt, Artificial Sequence; identical to SEQ ID NO: 199917
  derived and/or modified sequence opt5 from neuraminidase__InfluenzaA__ACR47003

SEQ ID NO: 199925 - RNA, 1410 nt, Artificial Sequence
  derived and/or modified sequence opt5 from neuraminidase__InfluenzaA__ACR47008
augaaccccaaucagaagaucauuaccaucggcagcgugugcaugacaauugggauggccaaccugauccuccaaauuggaaauaucaucuccauuuggccuguccacucuauccagcugggcaaccagaaucagauugagacguguaaccaaagcguuaucaccuacgaaaauaacacaugggugaaucagaccuaugugaacauuuccaauacaaacuucgcugccgggcagucugucgugagcaugaaacuugcgggaaauuccucucugugcccgguuggcgggugggcuaucuacagcaaggacaacuccgugagaauuggaagcaaaggcgaugucuuugugauccgggagcccuucaucucuuguuccccucucgaaugccgcaccuuuuuccugacacagggcgcccuucugaaugacaagcauagcaacgggaccauuaaagauagaucucccuaucggacgcucauguccuguccuaucggagagguucccagcccuuacaacucucgcuuugaauccguggccuggagcgcuuccgccugccacgacggcauuaauuggcugaccaucgggauuucuggaccggauaacggcgcugucgccgugcugaaguauaaugggaucaucacagacaccauuaagagcuggagaaacaauauccuccggacacaagaguccgagugugcgugcgugaacggaagcuguuucaccgucaugacggauggccccucuaauggccaggccuccuacaaaauuuuucgcaucgaaaaggggaaaauuguuaagagcguggagaugaacgcuccuaauuaucauuacgaagagugcucuuguuaccccgacagcuccgagaucacaugcgugugcagagauaacuggcacggaucuaaucggccuugggucagcuucaaccagaaucuggaauaucagaucggcuacauuuguuccgggaucuuuggagacaacccccgcccgaaugauaaaaccggcagcugcgggccugugucuuccaacggagccaacggcguuaagggcuucagcuuuaaguaugggaauggaguguggauuggcagaacaaaaucuaucuccagccggaacggguucgagaugauuugggaccccaauggauggaccggcaccgauaacaauuuuuccaucaagcaagacauugucgggaucaacgaauggucuggcuacagcggauccuucgugcagcauccugagcuuacaggccuggacuguauccgccccugcuucuggguugaacucauuagagggcggcccaaagagaauacgaucuggaccucuggaagcuccauuagcuuuuguggcgugaacucugauacagucgggugguccuggccugacggagcugagcugccguucaccaucgauaaguga

SEQ ID NO: 199926 - RNA, 1410 nt, Artificial Sequence; identical to SEQ ID NO: 199762
  derived and/or modified sequence opt5 from neuraminidase__InfluenzaA__ACR49267

SEQ ID NO: 199927 - RNA, 1410 nt, Artificial Sequence; identical to SEQ ID NO: 199752
  derived and/or modified sequence opt5 from neuraminidase__InfluenzaA__ACR49268

SEQ ID NO: 199928 - RNA, 1410 nt, Artificial Sequence; identical to SEQ ID NO: 199752
  derived and/or modified sequence opt5 from neuraminidase__InfluenzaA__ACR49269

SEQ ID NO: 199929 - RNA, 1410 nt, Artificial Sequence; identical to SEQ ID NO: 199752
  derived and/or modified sequence opt5 from neuraminidase__InfluenzaA__ACR49270

SEQ ID NO: 199930 - RNA, 1410 nt, Artificial Sequence; identical to SEQ ID NO: 199792
  derived and/or modified sequence opt5 from neuraminidase__InfluenzaA__ACR49271

SEQ ID NO: 199931 - RNA, 1410 nt, Artificial Sequence; identical to SEQ ID NO: 199762
  derived and/or modified sequence opt5 from neuraminidase__InfluenzaA__ACR49272

SEQ ID NO: 199932 - RNA, 1410 nt, Artificial Sequence; identical to SEQ ID NO: 199752
  derived and/or modified sequence opt5 from neuraminidase__InfluenzaA__ACR49273

SEQ ID NO: 199933 - RNA, 1410 nt, Artificial Sequence; identical to SEQ ID NO: 199752
  derived and/or modified sequence opt5 from neuraminidase__InfluenzaA__ACR49274

SEQ ID NO: 199934 - RNA, 1410 nt, Artificial Sequence; identical to SEQ ID NO: 199792
  derived and/or modified sequence opt5 from neuraminidase__InfluenzaA__ACR49275

SEQ ID NO: 199935 - RNA, 1410 nt, Artificial Sequence; identical to SEQ ID NO: 199792
  derived and/or modified sequence opt5 from neuraminidase__InfluenzaA__ACR49277

SEQ ID NO: 199936 - RNA, 1410 nt, Artificial Sequence; identical to SEQ ID NO: 199792
  derived and/or modified sequence opt5 from neuraminidase__InfluenzaA__ACR49278

SEQ ID NO: 199937 - RNA, 1410 nt, Artificial Sequence; identical to SEQ ID NO: 199752
  derived and/or modified sequence opt5 from neuraminidase__InfluenzaA__ACR49279

SEQ ID NO: 199938 - RNA, 1410 nt, Artificial Sequence; identical to SEQ ID NO: 199752
  derived and/or modified sequence opt5 from neuraminidase__InfluenzaA__ACR50994

SEQ ID NO: 199939 - RNA, 1410 nt, Artificial Sequence; identical to SEQ ID NO: 199762
  derived and/or modified sequence opt5 from neuraminidase__InfluenzaA__ACR50998

SEQ ID NO: 199940 - RNA, 1410 nt, Artificial Sequence; identical to SEQ ID NO: 199762
  derived and/or modified sequence opt5 from neuraminidase__InfluenzaA__ACR51008

SEQ ID NO: 199941 - RNA, 1410 nt, Artificial Sequence; identical to SEQ ID NO: 199762
  derived and/or modified sequence opt5 from neuraminidase__InfluenzaA__ACR51018

SEQ ID NO: 199942 - RNA, 1410 nt, Artificial Sequence; identical to SEQ ID NO: 199762
  derived and/or modified sequence opt5 from neuraminidase__InfluenzaA__ACR51028

SEQ ID NO: 199943 - RNA, 1410 nt, Artificial Sequence
  derived and/or modified sequence opt5 from neuraminidase__InfluenzaA__ACR51038
augaaccccaaucagaagaucauuaccaucggcagcgugugcauguccauugggauggccaaccugauccuccaaauuggaaauaucaucucuauuuggaucagccacuccauucagcugggcaaccagaaucagaucgagacauguaaccaaucugucauuacguacgaaaauaacaccuggguuaaucagacauaugugaacaucagcaauaccaacuucgcugccgggcaguccguggucucugugaaacuugcgggaaauagcucccugugcccuguuagcggcugggcuauuuacucuaaggacaacuccaucagaaucgggagcaaaggagauguguuugucauucgggagccguucaucucuuguagcccccucgaaugccgcacauuuuuccugacccagggcgcccuucugaaugacaagcauuccaacggcacaauuaaagauagaucuccuuaucggacccucauguccugucccaucggggaggugccuagccccuacaacucccgcuuugaaucuguugccuggagcgcuuccgccugccacgacggaauuaauuggcugacgaucggcaucagcgggccugauaacggagcuguggccguccugaaguauaauggcauuaucaccgacacaauuaagucuuggagaaacaauauccuccggacccaagaguccgagugugcgugcgugaacgggagcuguuucacagugaugaccgauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacgugcgugugcagagacaauuggcacgggagcaaccggcccugggugucuuucaaucagaaccuggaauaucagaucggauacauuuguuccggcaucuuuggggauaauccucgccccaacgacaaaacaggaagcugcggcccggucucuuccaauggggccaacggagugaagggcuucagcuuuaaguauggcaacgggguuuggauuggaagaaccaaauccaucucuagccggaauggcuucgagaugauuugggauccuaacggguggacaggaaccgacaauaacuuuuccaucaagcaagacaucgugggcauuaaugaauggucuggguacagcggcuccuucguccagcaucccgagcuuaccggacuggauuguauccgcccuugcuucuggguggaacucauuagaggccggcccaaagagaacacaaucuggacgagcgggucuuccauuagcuuuuguggaguuaauucugacaccgugggcugguccuggcccgauggggcugagcugccuuucacaaucgacaaguga

SEQ ID NO: 199944 - RNA, 1410 nt, Artificial Sequence; identical to SEQ ID NO: 199762
  derived and/or modified sequence opt5 from neuraminidase__InfluenzaA__ACR51048

SEQ ID NO: 199945 - RNA, 1410 nt, Artificial Sequence; identical to SEQ ID NO: 199762
  derived and/or modified sequence opt5 from neuraminidase__InfluenzaA__ACR51058

SEQ ID NO: 199946 - RNA, 1410 nt, Artificial Sequence; identical to SEQ ID NO: 199752
  derived and/or modified sequence opt5 from neuraminidase__InfluenzaA__ACR51068

SEQ ID NO: 199947 - RNA, 1410 nt, Artificial Sequence; identical to SEQ ID NO: 199762
  derived and/or modified sequence opt5 from neuraminidase__InfluenzaA__ACR52371

SEQ ID NO: 199948 - RNA, 1410 nt, Artificial Sequence; identical to SEQ ID NO: 199762
  derived and/or modified sequence opt5 from neuraminidase__InfluenzaA__ACR52381

SEQ ID NO: 199949 - RNA, 1410 nt, Artificial Sequence; identical to SEQ ID NO: 199762
  derived and/or modified sequence opt5 from neuraminidase__InfluenzaA__ACR52391

SEQ ID NO: 199950 - RNA, 1410 nt, Artificial Sequence; identical to SEQ ID NO: 199762
  derived and/or modified sequence opt5 from neuraminidase__InfluenzaA__ACR52401

SEQ ID NO: 199951 - RNA, 1410 nt, Artificial Sequence; identical to SEQ ID NO: 199762
  derived and/or modified sequence opt5 from neuraminidase__InfluenzaA__ACR52411

SEQ ID NO: 199952 - RNA, 1410 nt, Artificial Sequence; identical to SEQ ID NO: 199762
  derived and/or modified sequence opt5 from neuraminidase__InfluenzaA__ACR52421

SEQ ID NO: 199953 - RNA, 1410 nt, Artificial Sequence; identical to SEQ ID NO: 199762
  derived and/or modified sequence opt5 from neuraminidase__InfluenzaA__ACR52431

SEQ ID NO: 199954 - RNA, 1410 nt, Artificial Sequence; identical to SEQ ID NO: 199762
  derived and/or modified sequence opt5 from neuraminidase__InfluenzaA__ACR52441

SEQ ID NO: 199955 - RNA, 1410 nt, Artificial Sequence; identical to SEQ ID NO: 199762
  derived and/or modified sequence opt5 from neuraminidase__InfluenzaA__ACR52451

SEQ ID NO: 199956 - RNA, 1410 nt, Artificial Sequence; identical to SEQ ID NO: 199762
  derived and/or modified sequence opt5 from neuraminidase__InfluenzaA__ACR52471

SEQ ID NO: 199957 - RNA, 1410 nt, Artificial Sequence; identical to SEQ ID NO: 199762
  derived and/or modified sequence opt5 from neuraminidase__InfluenzaA__ACR52481

SEQ ID NO: 199958 - RNA, 1410 nt, Artificial Sequence; identical to SEQ ID NO: 199762
  derived and/or modified sequence opt5 from neuraminidase__InfluenzaA__ACR52491

SEQ ID NO: 199959 - RNA, 1410 nt, Artificial Sequence; identical to SEQ ID NO: 199762
  derived and/or modified sequence opt5 from neuraminidase__InfluenzaA__ACR54046

SEQ ID NO: 199960 - RNA, 1410 nt, Artificial Sequence; identical to SEQ ID NO: 199752
  derived and/or modified sequence opt5 from neuraminidase__InfluenzaA__ACR54052

SEQ ID NO: 199961 - RNA, 1410 nt, Artificial Sequence; identical to SEQ ID NO: 199762
  derived and/or modified sequence opt5 from neuraminidase__InfluenzaA__ACR54966

SEQ ID NO: 199962 - RNA, 1410 nt, Artificial Sequence; identical to SEQ ID NO: 199762
  derived and/or modified sequence opt5 from neuraminidase__InfluenzaA__ACR54976

SEQ ID NO: 199963 - RNA, 1410 nt, Artificial Sequence; identical to SEQ ID NO: 199762
  derived and/or modified sequence opt5 from neuraminidase__InfluenzaA__ACR54986

SEQ ID NO: 199964 - RNA, 1410 nt, Artificial Sequence; identical to SEQ ID NO: 199752
  derived and/or modified sequence opt5 from neuraminidase__InfluenzaA__ACR54996

SEQ ID NO: 199965 - RNA, 1410 nt, Artificial Sequence; identical to SEQ ID NO: 199762
  derived and/or modified sequence opt5 from neuraminidase__InfluenzaA__ACR55006

SEQ ID NO: 199966 - RNA, 1410 nt, Artificial Sequence; identical to SEQ ID NO: 199752
  derived and/or modified sequence opt5 from neuraminidase__InfluenzaA__ACR56383

SEQ ID NO: 199967 - RNA, 1410 nt, Artificial Sequence; identical to SEQ ID NO: 199752
  derived and/or modified sequence opt5 from neuraminidase__InfluenzaA__ACR56393

SEQ ID NO: 199968 - RNA, 1410 nt, Artificial Sequence; identical to SEQ ID NO: 199762
  derived and/or modified sequence opt5 from neuraminidase__InfluenzaA__ACR56403

SEQ ID NO: 199969 - RNA, 1410 nt, Artificial Sequence; identical to SEQ ID NO: 199762
  derived and/or modified sequence opt5 from neuraminidase__InfluenzaA__ACR56413

SEQ ID NO: 199970 - RNA, 1410 nt, Artificial Sequence; identical to SEQ ID NO: 199762
  derived and/or modified sequence opt5 from neuraminidase__InfluenzaA__ACR56423

SEQ ID NO: 199971 - RNA, 1410 nt, Artificial Sequence; identical to SEQ ID NO: 199762
  derived and/or modified sequence opt5 from neuraminidase__InfluenzaA__ACR56433

SEQ ID NO: 199972 - RNA, 1410 nt, Artificial Sequence; identical to SEQ ID NO: 199762
  derived and/or modified sequence opt5 from neuraminidase__InfluenzaA__ACR56443

SEQ ID NO: 199973 - RNA, 1410 nt, Artificial Sequence; identical to SEQ ID NO: 199762
  derived and/or modified sequence opt5 from neuraminidase__InfluenzaA__ACR56453

SEQ ID NO: 199974 - RNA, 1413 nt, Artificial Sequence; identical to SEQ ID NO: 199740
  derived and/or modified sequence opt5 from neuraminidase__InfluenzaA__ACR58555

SEQ ID NO: 199975 - RNA, 1413 nt, Artificial Sequence
  derived and/or modified sequence opt5 from neuraminidase__InfluenzaA__ACR61658
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgagaauagcacaugggugaaccacaccuaugucucuaucaauaacacaaauguugugaccggaaaagacaagacaagcgugacccuggccggcaacuccagccuuuguucuauuuccgggugggcgaucuacacgaaagauaauagcauucggaucggaucuaagggcgacgucuucgugauucgcgaaccuuuuaucuccugcagccaucuggaguguagaaccuucuuucucacacaaggcgcucugcuuaacgauaaacacucuaaugggaccguuaaggaccgguccccguaucgcgcccugaugagcugcccccucggagaagccccuucccccuacaacucuaaguucgagagcguggcuugguccgccagcgcuugucaugauggcaugggguggcugacaaucggaauuucuggcccugacaauggggccgucgcggugcugaaauauaacggaaucauuaccgaaacgaucaaguccuggaaaaagcggauucucagaacacaggagagcgagugcguuugugugaacggcucuugcuuuaccaucaugacagauggccccagcaauggggccgcuuccuacaaaaucuucaagauugaaaagggaaaagucaccaagucuaucgagcugaacgccccuaauuuucacuaugaagaguguagcugcuacccggacaccggcacagugaugugugugugccgcgauaacuggcacggguccaauagacccugggucagcuucaaccagaaucuugacuaccagauuggauauaucugcucuggcguuuuuggggauaacccucggcccaaagacggaaagggcuccuguaauccugugacgguggauggcgcugacggggucaaaggauucagcuacaaguauggcaacgggguguggauuggacgcaccaaaucuaauagacugcggaagggcuuugagaugaucugggaccccaacggguggacagauaccgacuccgauuucagcguuaagcaagacguggucgccauuacagauugguccggcuacucuggauccuuugugcagcauccggaacucaccggccuggacugcauccgcccuuguuucuggguugagcuugugagagggcugccccgggaaaauacgacaaucuggaccuccggaucuagcauuuccuucugcggcgucgauagcgacaccgcgaacuggucuuggccugauggggccgagcuccccuuuacaaucgacaaauga

SEQ ID NO: 199976 - RNA, 1410 nt, Artificial Sequence
  derived and/or modified sequence opt5 from neuraminidase__InfluenzaA__ACR61680
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaaugauaccguucgggaccgcacgccguauagaacacuccugaugaacgaacugggcgugcccuuucaccucgggaccaagcaggucugcauugccugguccucuagcuccugucaugauggaaaagccuggcugcacgugugcaucacaggcgacgauaagaaugcuaccgccagcuucauuuacaacggccggcuuguugacucuguggucuccuggagcaaagagauccugcgcacccaggaaucugagugugugugcauuaaugggacauguaucguggucaugacggauggauccgcuagcggcaaggccgacaccaaaauccucuuuauugaggaagggaagaucguucauacauccacccugucuggaagcgcgcaacacguggaggaaugcuccugcuauccuagauaccccggcgugcggugugucugccgcgauaacuggaaggggagcaacagaccuauuguggacaucaauauuaaagaccacucuaucguuuccagcuacguguguucuggacuugucggcgauacaccccggaagaacgacagcuccucuagcucccauugccuggauccgaauaacgaggaaggcgggcacggagugaaaggcugggccuucgacgaugggaaugacguuuggaugggacgcaccaucagcgagaagucuagacucggcuaugagacguuuaaagugauugaagggugguccaacccuaagagcaaacugcagaucaaucggcaggucauuguggaucgcggaaacagaucuggcuacuccggcaucuucagcgucgaggggaaguccuguauuaaucggugcuuuuauguggaacugaucagaggacgcaaggaggaaacagagguucucuggaccucuaacagcauuguggucuucuguggcaccuccgggacauacggaaccggcucuuggcccgacggggcugauaucaaucugaugccuaucuga

SEQ ID NO: 199977 - RNA, 1410 nt, Artificial Sequence
  derived and/or modified sequence opt5 from neuraminidase__InfluenzaA__ACR61691
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugccauaaacucgcugaguaccggaauugguccaagccucagugugacauuaccggguucgcccccuuuucuaaagauaacagcauccgccuguccgcgggaggcgacaucugggugacaagagagccuuaugucucuugcgaucccgacaaguguuaccaauucgcucuugggcagggaaccacacugaauaacgugcacagcaauaacaccguucgggaucgcacgccuuauagaacacuccugaugaaugaacugggcgugccguuucaucucgggaccaagcaggucugcauugccugguccagcagcuccugucacgacggaaaagccuggcugcaugugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuaucccagauacccuggcgugcggugugucugccgcgacaacuggaaggggagcaauagacccaucguggauauuaacaucaaagaccauucuauuguuuccagcuacguguguucuggacuugucggcgacaccccucggaagaaugauagcuccucuagcucccacugccuggaccccaacaaugaggaaggcgggcauggagugaaaggcugggccuucgaugacgggaacgauguuuggaugggacgcacgaucagcgagaagucuagacucggcuaugagacauuuaaagugaucgaagggugguccaauccgaagucuaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggccugauggggcugacauuaaccugaugcccaucuga

SEQ ID NO: 199978 - RNA, 1410 nt, Artificial Sequence
  derived and/or modified sequence opt5 from neuraminidase__InfluenzaA__ACR61702
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcuccaacugccuggacccgaauaacgaggaaggcgggcauggagugaaaggcugggccuucgaugacgggaaugauguuuggaugggacgcaccaucagcgagaagucuagacucggcuaugagacauuuaaagugaucgaagggugguccaacccuaagagcaaacugcagauuaaucggcaggucaucguggaccgcggaaacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggcccgauggggcugacauuaaucugaugccuaucuga

SEQ ID NO: 199979 - RNA, 1410 nt, Artificial Sequence; identical to SEQ ID NO: 199752
  derived and/or modified sequence opt5 from neuraminidase__InfluenzaA__ACR67201

SEQ ID NO: 199980 - RNA, 1410 nt, Artificial Sequence; identical to SEQ ID NO: 199762
  derived and/or modified sequence opt5 from neuraminidase__InfluenzaA__ACR67202

SEQ ID NO: 199981 - RNA, 1410 nt, Artificial Sequence; identical to SEQ ID NO: 199752
  derived and/or modified sequence opt5 from neuraminidase__InfluenzaA__ACR67203

SEQ ID NO: 199982 - RNA, 1410 nt, Artificial Sequence; identical to SEQ ID NO: 199762
  derived and/or modified sequence opt5 from neuraminidase__InfluenzaA__ACR67204

SEQ ID NO: 199983 - RNA, 1410 nt, Artificial Sequence; identical to SEQ ID NO: 199762
  derived and/or modified sequence opt5 from neuraminidase__InfluenzaA__ACR67246

SEQ ID NO: 199984 - RNA, 1410 nt, Artificial Sequence; identical to SEQ ID NO: 199752
  derived and/or modified sequence opt5 from neuraminidase__InfluenzaA__ACR67256

SEQ ID NO: 199985 - RNA, 1410 nt, Artificial Sequence; identical to SEQ ID NO: 199762
  derived and/or modified sequence opt5 from neuraminidase__InfluenzaA__ACR77451

SEQ ID NO: 199986 - RNA, 1410 nt, Artificial Sequence; identical to SEQ ID NO: 199762
  derived and/or modified sequence opt5 from neuraminidase__InfluenzaA__ACR77461

SEQ ID NO: 199987 - RNA, 1410 nt, Artificial Sequence; identical to SEQ ID NO: 199762
  derived and/or modified sequence opt5 from neuraminidase__InfluenzaA__ACR77471

SEQ ID NO: 199988 - RNA, 1410 nt, Artificial Sequence; identical to SEQ ID NO: 199762
  derived and/or modified sequence opt5 from neuraminidase__InfluenzaA__ACR77481

SEQ ID NO: 199989 - RNA, 1410 nt, Artificial Sequence; identical to SEQ ID NO: 199762
  derived and/or modified sequence opt5 from neuraminidase__InfluenzaA__ACR77491

SEQ ID NO: 199990 - RNA, 1410 nt, Artificial Sequence; identical to SEQ ID NO: 199762
  derived and/or modified sequence opt5 from neuraminidase__InfluenzaA__ACR77501

SEQ ID NO: 199991 - RNA, 1410 nt, Artificial Sequence; identical to SEQ ID NO: 199762
  derived and/or modified sequence opt5 from neuraminidase__InfluenzaA__ACR83527

SEQ ID NO: 199992 - RNA, 1410 nt, Artificial Sequence; identical to SEQ ID NO: 199762
  derived and/or modified sequence opt5 from neuraminidase__InfluenzaA__ACR83539

SEQ ID NO: 199993 - RNA, 1410 nt, Artificial Sequence; identical to SEQ ID NO: 199762
  derived and/or modified sequence opt5 from neuraminidase__InfluenzaA__ACS14669

SEQ ID NO: 199994 - RNA, 1410 nt, Artificial Sequence; identical to SEQ ID NO: 199762
  derived and/or modified sequence opt5 from neuraminidase__InfluenzaA__ACS14679

SEQ ID NO: 199995 - RNA, 1410 nt, Artificial Sequence; identical to SEQ ID NO: 199762
  derived and/or modified sequence opt5 from neuraminidase__InfluenzaA__ACS14689

SEQ ID NO: 199996 - RNA, 1410 nt, Artificial Sequence; identical to SEQ ID NO: 199762
  derived and/or modified sequence opt5 from neuraminidase__InfluenzaA__ACS14699

SEQ ID NO: 199997 - RNA, 1410 nt, Artificial Sequence; identical to SEQ ID NO: 199762
  derived and/or modified sequence opt5 from neuraminidase__InfluenzaA__ACS14709

SEQ ID NO: 199998 - RNA, 1410 nt, Artificial Sequence; identical to SEQ ID NO: 199762
  derived and/or modified sequence opt5 from neuraminidase__InfluenzaA__ACS14719

SEQ ID NO: 199999 - RNA, 1410 nt, Artificial Sequence; identical to SEQ ID NO: 199762
  derived and/or modified sequence opt5 from neuraminidase__InfluenzaA__ACS14729

SEQ ID NO: 200000 - RNA, 1410 nt, Artificial Sequence; identical to SEQ ID NO: 199762
  derived and/or modified sequence opt5 from neuraminidase__InfluenzaA__ACS14739

SEQ ID NO: 200001 - RNA, 1410 nt, Artificial Sequence; identical to SEQ ID NO: 199752
  derived and/or modified sequence opt5 from neuraminidase__InfluenzaA__ACS27192

SEQ ID NO: 200002 - RNA, 1410 nt, Artificial Sequence; identical to SEQ ID NO: 199762
  derived and/or modified sequence opt5 from neuraminidase__InfluenzaA__ACS27202

SEQ ID NO: 200003 - RNA, 1410 nt, Artificial Sequence; identical to SEQ ID NO: 199762
  derived and/or modified sequence opt5 from neuraminidase__InfluenzaA__ACS27212

SEQ ID NO: 200004 - RNA, 1410 nt, Artificial Sequence; identical to SEQ ID NO: 199752
  derived and/or modified sequence opt5 from neuraminidase__InfluenzaA__ACS27222

SEQ ID NO: 200005 - RNA, 1410 nt, Artificial Sequence; identical to SEQ ID NO: 199762
  derived and/or modified sequence opt5 from neuraminidase__InfluenzaA__ACS27232

SEQ ID NO: 200006 - RNA, 1410 nt, Artificial Sequence; identical to SEQ ID NO: 199752
  derived and/or modified sequence opt5 from neuraminidase__InfluenzaA__ACS27242

SEQ ID NO: 200007 - RNA, 1410 nt, Artificial Sequence; identical to SEQ ID NO: 199762
  derived and/or modified sequence opt5 from neuraminidase__InfluenzaA__ACS27252

SEQ ID NO: 200008 - RNA, 1410 nt, Artificial Sequence; identical to SEQ ID NO: 199752
  derived and/or modified sequence opt5 from neuraminidase__InfluenzaA__ACS27771

SEQ ID NO: 200009 - RNA, 1410 nt, Artificial Sequence; identical to SEQ ID NO: 199917
  derived and/or modified sequence opt5 from neuraminidase__InfluenzaA__ACS34969

SEQ ID NO: 200010 - RNA, 1410 nt, Artificial Sequence; identical to SEQ ID NO: 199917
  derived and/or modified sequence opt5 from neuraminidase__InfluenzaA__ACS34970

SEQ ID NO: 200011 - RNA, 1410 nt, Artificial Sequence; identical to SEQ ID NO: 199917
  derived and/or modified sequence opt5 from neuraminidase__InfluenzaA__ACS34971

SEQ ID NO: 200012 - RNA, 1410 nt, Artificial Sequence; identical to SEQ ID NO: 199762
  derived and/or modified sequence opt5 from neuraminidase__InfluenzaA__ACS34972

SEQ ID NO: 200013 - RNA, 1410 nt, Artificial Sequence; identical to SEQ ID NO: 199762
  derived and/or modified sequence opt5 from neuraminidase__InfluenzaA__ACS50081

SEQ ID NO: 200014 - RNA, 1410 nt, Artificial Sequence; identical to SEQ ID NO: 199762
  derived and/or modified sequence opt5 from neuraminidase__InfluenzaA__ACS50087

SEQ ID NO: 200015 - RNA, 1410 nt, Artificial Sequence; identical to SEQ ID NO: 199762
  derived and/or modified sequence opt5 from neuraminidase__InfluenzaA__ACS50094

SEQ ID NO: 200016 - RNA, 1410 nt, Artificial Sequence; identical to SEQ ID NO: 199752
  derived and/or modified sequence opt5 from neuraminidase__InfluenzaA__ACS54264

SEQ ID NO: 200017 - RNA, 1410 nt, Artificial Sequence; identical to SEQ ID NO: 199917
  derived and/or modified sequence opt5 from neuraminidase__InfluenzaA__ACS54265

SEQ ID NO: 200018 - RNA, 1410 nt, Artificial Sequence; identical to SEQ ID NO: 199762
  derived and/or modified sequence opt5 from neuraminidase__InfluenzaA__ACS54266

SEQ ID NO: 200019 - RNA, 1410 nt, Artificial Sequence; identical to SEQ ID NO: 199762
  derived and/or modified sequence opt5 from neuraminidase__InfluenzaA__ACS54267

SEQ ID NO: 200020 - RNA, 1410 nt, Artificial Sequence; identical to SEQ ID NO: 199762
  derived and/or modified sequence opt5 from neuraminidase__InfluenzaA__ACS54268

SEQ ID NO: 200021 - RNA, 1410 nt, Artificial Sequence; identical to SEQ ID NO: 199762
  derived and/or modified sequence opt5 from neuraminidase__InfluenzaA__ACS54303

SEQ ID NO: 200022 - RNA, 1410 nt, Artificial Sequence; identical to SEQ ID NO: 199762
  derived and/or modified sequence opt5 from neuraminidase__InfluenzaA__ACS68823

SEQ ID NO: 200023 - RNA, 1410 nt, Artificial Sequence; identical to SEQ ID NO: 199762
  derived and/or modified sequence opt5 from neuraminidase__InfluenzaA__ACS75824

SEQ ID NO: 200024 - RNA, 1410 nt, Artificial Sequence; identical to SEQ ID NO: 199762
  derived and/or modified sequence opt5 from neuraminidase__InfluenzaA__ACS77929

SEQ ID NO: 200025 - RNA, 1410 nt, Artificial Sequence; identical to SEQ ID NO: 199762
  derived and/or modified sequence opt5 from neuraminidase__InfluenzaA__ACS77939

SEQ ID NO: 200026 - RNA, 1410 nt, Artificial Sequence; identical to SEQ ID NO: 199752
  derived and/or modified sequence opt5 from neuraminidase__InfluenzaA__ACS77949

SEQ ID NO: 200027 - RNA, 1410 nt, Artificial Sequence; identical to SEQ ID NO: 199762
  derived and/or modified sequence opt5 from neuraminidase__InfluenzaA__ACS77959

SEQ ID NO: 200028 - RNA, 1410 nt, Artificial Sequence; identical to SEQ ID NO: 199762
  derived and/or modified sequence opt5 from neuraminidase__InfluenzaA__ACS77969

SEQ ID NO: 200029 - RNA, 1410 nt, Artificial Sequence; identical to SEQ ID NO: 199762
  derived and/or modified sequence opt5 from neuraminidase__InfluenzaA__ACS77979

SEQ ID NO: 200030 - RNA, 1410 nt, Artificial Sequence; identical to SEQ ID NO: 199762
  derived and/or modified sequence opt5 from neuraminidase__InfluenzaA__ACS77989

SEQ ID NO: 200031 - RNA, 1410 nt, Artificial Sequence; identical to SEQ ID NO: 199762
  derived and/or modified sequence opt5 from neuraminidase__InfluenzaA__ACS77999

SEQ ID NO: 200032 - RNA, 1410 nt, Artificial Sequence; identical to SEQ ID NO: 199762
  derived and/or modified sequence opt5 from neuraminidase__InfluenzaA__ACS78009

SEQ ID NO: 200033 - RNA, 1410 nt, Artificial Sequence; identical to SEQ ID NO: 199762
  derived and/or modified sequence opt5 from neuraminidase__InfluenzaA__ACS78019

SEQ ID NO: 200034 - RNA, 1410 nt, Artificial Sequence; identical to SEQ ID NO: 199762
  derived and/or modified sequence opt5 from neuraminidase__InfluenzaA__ACS78039

SEQ ID NO: 200035 - RNA, 1410 nt, Artificial Sequence; identical to SEQ ID NO: 199762
  derived and/or modified sequence opt5 from neuraminidase__InfluenzaA__ACS78049

SEQ ID NO: 200036 - RNA, 1410 nt, Artificial Sequence; identical to SEQ ID NO: 199762
  derived and/or modified sequence opt5 from neuraminidase__InfluenzaA__ACS88274

SEQ ID NO: 200037 - RNA, 1410 nt, Artificial Sequence; identical to SEQ ID NO: 199762
  derived and/or modified sequence opt5 from neuraminidase__InfluenzaA__ACS88275

SEQ ID NO: 200038 - RNA, 1410 nt, Artificial Sequence; identical to SEQ ID NO: 199752
  derived and/or modified sequence opt5 from neuraminidase__InfluenzaA__ACS92572

SEQ ID NO: 200039 - RNA, 1410 nt, Artificial Sequence; identical to SEQ ID NO: 199752
  derived and/or modified sequence opt5 from neuraminidase__InfluenzaA__ACS92582

SEQ ID NO: 200040 - RNA, 1410 nt, Artificial Sequence; identical to SEQ ID NO: 199762
  derived and/or modified sequence opt5 from neuraminidase__InfluenzaA__ACS92592

SEQ ID NO: 200041 - RNA, 1410 nt, Artificial Sequence; identical to SEQ ID NO: 199762
  derived and/or modified sequence opt5 from neuraminidase__InfluenzaA__ACS92603

SEQ ID NO: 200042 - RNA, 1410 nt, Artificial Sequence; identical to SEQ ID NO: 199752
  derived and/or modified sequence opt5 from neuraminidase__InfluenzaA__ACS92614

SEQ ID NO: 200043 - RNA, 1410 nt, Artificial Sequence; identical to SEQ ID NO: 199762
  derived and/or modified sequence opt5 from neuraminidase__InfluenzaA__ACT09115

SEQ ID NO: 200044 - RNA, 1410 nt, Artificial Sequence; identical to SEQ ID NO: 199762
  derived and/or modified sequence opt5 from neuraminidase__InfluenzaA__ACT10309

SEQ ID NO: 200045 - RNA, 1410 nt, Artificial Sequence; identical to SEQ ID NO: 199762
  derived and/or modified sequence opt5 from neuraminidase__InfluenzaA__ACT10315

SEQ ID NO: 200046 - RNA, 1410 nt, Artificial Sequence; identical to SEQ ID NO: 199752
  derived and/or modified sequence opt5 from neuraminidase__InfluenzaA__ACT11059

SEQ ID NO: 200047 - RNA, 1350 nt, Artificial Sequence
  derived and/or modified sequence opt5 from neuraminidase__InfluenzaA__ACT15313
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggguguccuucaaucagaaccuggaauaucaaauuggauacaucuguagcggcgucuuuggggacaauccucgccccaacgauggaacaggcucuugcgggccgguguucccuaauggagcuuacggcguuaagggcuuuuccuucaaguaugggaacggaguguggauuggcagaaccaaaagcacaaauucucgguccggguuugagaugaucugggaccccaacggauggaccggcaccgacagcuccuucucugucaagcaggauauuguggccaucacagacuggagcggguacuccggcucuuucguucagcacccugaacuuacgggacuggauuguauccgccccugcuuuuggguggagcucauuagaggccggcccaaagaaagcaccaucuggacauccgggagcucuauuuccuucuguggagucaauggcgacaccgugagcuggucuuggccugauggggcggagcugccguuuacaaucgacaaguga

SEQ ID NO: 200048 - RNA, 1350 nt, Artificial Sequence
  derived and/or modified sequence opt5 from neuraminidase__InfluenzaA__ACT15315
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuaugcgggagcccuucauuuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaaucuccggcccugacaacggggcuguugccgugcugaaguacaauggaauuaucaccgauacaauuaagagcuggcggaacaauaucaugcgcacccaggagucugagugugcgugcgucaacggcuccuguuucacagugaugaccgacgggccgagcucuggacaggccagcuauaaaauuuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggguguccuucaaucagaaccuggaauaucaaaucggauacauuuguagcggcgucuuuggggacaauccucgccccaacgauggaacaggcucuugcgggccgguguucccuaauggagcuuacggcguuaagggcuuuuccuucaaguaugggaacggaguguggaucggcagaaccaaaagcacaaauucucgguccggguuugagaugauuugggaccccaacggauggaccggcaccgacagcuccuucucugucaagcaggauaucguggccauuacagacuggagcggguacuccggcucuuucguucagcacccugaacuuacgggacuggauuguauccgccccugcuuuuggguggagcucaucagaggccggcccaaagaaagcaccauuuggacauccgggagcucuaucuccuucuguggagucaauggcgacaccgugagcuggucuuggccugauggggcggagcugccguuuacaauugacaaguga

SEQ ID NO: 200049 - RNA, 1350 nt, Artificial Sequence; identical to SEQ ID NO: 200047
  derived and/or modified sequence opt5 from neuraminidase__InfluenzaA__ACT15319

SEQ ID NO: 200050 - RNA, 1350 nt, Artificial Sequence
  derived and/or modified sequence opt5 from neuraminidase__InfluenzaA__ACT15321
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaagagccguggcuagcgugacacuugccggaaauuccucucugugcccgaucagcgggugggcggucuacuccaaggauaacagcauucggaucggcucucgcggggacguguuuguuauuagagagcccuucaucuccuguagccaucucgaaugccggaccuuuuuccugacacaaggagcccuucugaaugauaaacacucuaacggcaccgugaaggaccgcuccccucauagaacacucaugagcugucccgucggcgaggcuccuucucccuauaauucccgguuugaaagcguggccugguccgcuucugccugccacgaugggaccagcuggcugacgaucggaauuuccggcccugacaacggggcuguugccgugcugaaauacaauggaaucauuaccgauacaaucaagagcuggcgcaacaauauuaugagaacccaggagucugagugugcgugcgucaacggcuccuguuucacagugaugaccgacgggccgagcucuggacaggccagcuauaagaucuuuaaaauggaaaagggcaaaguggucaaguccguugagcucgaugcucccaauuaccauuaugaagagugcucuuguuacccugacgccggcgagaucacgugcgugugccgggauaacuggcacgggagcaaccgccccuggguguccuucaaucagaaccuggaauaucaaauuggauacaucuguagcggcgucuuuggggacaauccuagacccaacgauggaacaggcucuugcgggccgguguucccuaauggagcuuacggcguuaaaggcuuuuccuucaaguaugggaacggaguguggauuggccggaccaagagcacaaauucucgcuccggguuugagaugaucugggaccccaacggauggaccggcaccgacagcuccuucucugucaaacaggauauuguggccaucacagacuggagcggguacuccggcucuuucguucagcacccugaacuuacgggacuggauuguaucagacccugcuuuuggguggagcucauucggggccgccccaaggaaagcaccaucuggacauccgggagcucuauuuccuucuguggagucaauggcgacaccgugagcuggucuuggccugauggggcggagcugccguuuacaaucgacaaauga

SEQ ID NO: 200051 - RNA, 1350 nt, Artificial Sequence; identical to SEQ ID NO: 200047
  derived and/or modified sequence opt5 from neuraminidase__InfluenzaA__ACT15323

SEQ ID NO: 200052 - RNA, 1350 nt, Artificial Sequence; identical to SEQ ID NO: 200047
  derived and/or modified sequence opt5 from neuraminidase__InfluenzaA__ACT15325

SEQ ID NO: 200053 - RNA, 1350 nt, Artificial Sequence
  derived and/or modified sequence opt5 from neuraminidase__InfluenzaA__ACT15327
augaaccccaaucagaagaucauuaccaucggcagcauuugcauggugaucgggauugucucccugaugcuccaaaucggaaacaugaucucuauuuggguuagccacuccauccagacaggcaauagaugucaggacgagccuauuucuaacacgaaauuccugaccgaaaaggccguggcuagcgugacacuugccggaaauuccucucugugcccgaucagcgggugggcggucuacuccaaagauaacagcauucggaucggcucucgcggggacguguuuguuauuagagagcccuucaucuccuguagccaucucgaaugccggaccuuuuuccugacacagggagcccuucugaaugauaagcacucuaacggcaccgugaaagaccgcuccccucauagaacacucaugagcugucccgucggcgaggcuccuucucccuauaauucccgguuugaaagcguggccugguccgcuucugccugccacgaugggaccagcuggcugacgaucggaauuuccggcccugacaacggggcuguugccgugcugaaguacaauggaaucauuaccgauacaaucaagagcuggcgcaacaauauuaugagaacccaagagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugccgggauaacuggcacgggagcaaccgccccuggguguccuucaaucagaaccuggaauauaagauuggauacaucuguagcggcauuuuuggggacaauccuagacccaacgauggaacaggcucuugcgggccggucuucccuaauggagcuuacggcgugaagggcuuuuccuucaaauaugggaacggaguuuggaucggccggaccaagagcacaaauucucgcuccggguuugagaugauuugggaccccaacggauggaccggcaccgacagcuccuucucugugaaacaggauaucgucgccaucacagacuggagcggguacuccggcucuuucgugcaacacccugaacuuacgggacuggauuguauuagacccugcuuuuggguugagcucauccggggccgccccaaggaaagcaccauuuggacauccgggagcucuaucuccuucuguggagugaauggcgacaccgucagcuggucuuggccugauggggcggagcugccguuuacaauugacaaauga

SEQ ID NO: 200054 - RNA, 1350 nt, Artificial Sequence
  derived and/or modified sequence opt5 from neuraminidase__InfluenzaA__ACT15331
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggguguccuucaaucagaaccuggaauaucaaauuggauacaucuguagcggcgucuuuggggacaauccucgccccaacgauggaacaggcucuugcgggccgguguucccuaauggagcuuacggcguuaagggcuuuuccuucaaguaugggaacggaguguggauuggcagaaccaaaagcacaaauucucgguccggguuugagaugaucugggaccccaacggauggaccggcaccgacagcuccuucucugucaagcaggauauuguggccaucacagacuggagcggguacuccggcucuuucguucagcacccugaacuuacgggacuggauuguauccgccccugcuuuuggguggagcucauuagaggccggcccaaagaaagcaccaucuggacauccgggagcucuauuuccuucuguggagucaauagcgacaccgugucuugguccuggccugauggcgcggagcugccguuuacaaucgacaaguga

SEQ ID NO: 200055 - RNA, 1350 nt, Artificial Sequence
  derived and/or modified sequence opt5 from neuraminidase__InfluenzaA__ACT15333
augaaccccaaucagaagaucauuaccaucggcagcauuugcauggugaucgggauugucucccugaugcuccaaaucggaaacaugaucucuauuuggguuagccacuccauccagacaggcaaucagugucagggggagccuauuucuaacacgaaauuccugaccgaaaaggccguggcuagcgugacacuugccggaaauuccucucugugcccgaucagcggcugggcggucuacuccaaagacaacagcauuagaaucgggucucggggagauguguuuguuauucgcgagcccuucaucuccuguagccaucucgaaugcagaaccuuuuuccugacacaaggcgcccuucugaaugacaagcacucuaacggcaccgugaaagaucgguccccucaucgcacacucaugagcugucccgucggggaggcuccuucucccuauaauuccagauuugaaagcguggccugguccgcuucugccugccacgacggaaccagcuggcugacgaucggcauuuccgggccugauaacggagcuguugccgugcugaaguacaauggcaucauuaccgacacaaucaagagcuggcggaacaauauucuccgcacccaggagucugagugugcgugcgucaacggguccuguuucacagugaugaccgauggaccgagcucuggccaggccagcuauaaaaucuuuaagauggaaaaaggcaagguggucaaauccguugagcuggacgcucccaauuaccauuaugaagagugcucuuguuacccugaugccggggagaucacgugcgugugcagagacaacuggcacggaagcaaccggcccuggguguccuucaaucagaaccuugaauaucaaauuggcuacaucuguagcggggucuuuggagauaauccucgccccaacgacggcacagggucuugcggaccggugguuuccaauggcgcuuacggcgugaagggguucagcuuuaaguauggaaacggcgucuggauugggagaaccaaaucuacaaauucccggagcggauucgagaugaucugggauccuaacggcuggaccgggaccgacuccucuuuuagcggcaagcaggacauuguggccaucacagauugguccggauacucuggcagcuucguucagcaccccgaacugacggggcucgacuguauccgcccuugcuucuggguggagcugauuagaggacggcccaaagaauccaccaucuggacaagcgggucuuccauuagcuuuuguggcgucaauucugauaccguguccuggagcuggcccgacggagcggagcuuccuuucacaaucgauaaguga

SEQ ID NO: 200056 - RNA, 1350 nt, Artificial Sequence
  derived and/or modified sequence opt5 from neuraminidase__InfluenzaA__ACT15335
augaaccccaaucagaagaucauuaccaucggcagcauuugcauggugaucgggauugucucccugaugcuccaaaucggaaacaugaucucuauuuggguuagccacuccauccagacaggcaauagaugucaggacgagccuauuucuaacacgaaauuccugaccgaaaaggccguggcuagcgugacacuugccggaaauuccucucugugcccgaucagcgggugggcggucuacuccaaagauaacagcauucggaucggcucucgcggggacguguuuguuauuagagagcccuucaucuccuguagccaucucgaaugccggaccuuuuuccugacacagggagcccuucugaaugauaagcacucuaacggcaccgugaaagaccgcuccccucauagaacacucaugagcugucccgucggcgaggcuccuucucccuauaauucccgguuugaaagcguggccugguccgcuucugccugccacgaugggaccagcuggcugacgaucggaauuuccggcccugacaacggggcuguugccgugcugaaguacaauggaaucauuaccgauacaaucaagagcuggcgcaacaauauuaugagaacccaagagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugccgggauaacuggcacgggagcaaccgccccuggguguccuucaaucagaaccuggaauauaagauuggauacaucuguagcggcauuuuuggggacaauccuagacccaacgauggaacaggcucuugcgggccgguccuuccuaauggagcuuacggcgugaagggcuucuccuuuaaauaugggaacggaguuuggaucggccggaccaagagcacaaauucucgcuccggguucgagaugauuugggaccccaacggauggaccggcaccgacagcuccuuuucugugaaacaggauaucgucgccaucacagacuggagcggguacuccggcucuuucgugcaacacccugaacugacgggacucgauuguauuagacccugcuucuggguugagcugauccggggccgccccaaggaaagcaccauuuggacauccgggagcucuaucuccuuuuguggagugaauggcgacaccgucagcuggucuuggccugauggggcggagcuuccguucacaauugacaaauga

SEQ ID NO: 200057 - RNA, 1350 nt, Artificial Sequence
  derived and/or modified sequence opt5 from neuraminidase__InfluenzaA__ACT15337
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggguguccuucaaucagaaccuggaauaucaaauuggauacaucuguagcggcgucuuuggggacaauccucgccccaacgauggaacaggcucuugcgggccgguguucccuaauggagcuuacggcguuaagggcuuuuccuucaaguaugggaacggaguguggauuggcagaaccaaaagcacaaauucucgguccggguuugagaugaucugggaccccaacggauggaccggcaccgacagcuccuucucugucaagcaggauauuguggccguuacagacuggagcggguacuccggcucuuucgugcagcacccugaacuuacgggacuggauuguauccgccccugcuuuugggucgagcucaucagaggccggcccaaagaaagcaccauuuggacauccgggagcucuaucuccuucuguggagugaauggcgacaccgucagcuggucuuggccugauggggcggagcugccguuuacaauugacaaguga

SEQ ID NO: 200058 - RNA, 1350 nt, Artificial Sequence; identical to SEQ ID NO: 200047
  derived and/or modified sequence opt5 from neuraminidase__InfluenzaA__ACT15341

SEQ ID NO: 200059 - RNA, 1350 nt, Artificial Sequence
  derived and/or modified sequence opt5 from neuraminidase__InfluenzaA__ACT15344
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggucuaacauuaugcgcacccaggaguccgagugugcgugcgucaauggcagcuguuucacagugaugaccgacgggccgucuagcggacaggccuccuauaaaaucuuuaagauggaaaaaggcaagguggucaaaucuguugagcucgaugcucccaacuaccauuaugaagagugcagcuguuacccugacgccggcgagaucacgugcgugugcagagauaauuggcacggguccaaccggcccugggugagcuucaaccagaaucuggaauaucaaauuggauacaucuguucuggcgucuuuggggacaacccucgccccaaugauggaacaggcuccugcgggccgguguucccuaacggagcuuacggcguuaagggcuuuagcuucaaguaugggaauggaguguggauuggcagaaccaaaucuacaaacucccggagcggguuugagaugaucugggaccccaauggauggaccggcaccgacuccucuuucagcgucaagcaggauauuguggccaucacagacugguccggguacucuggcagcuucguucagcacccugaacuuacgggacuggauuguauccgccccugcuuuuggguggagcucauuagaggccggcccaaagaauccaccaucuggacaagcgggucuuccauuagcuucuguggagucaacggcgacaccgugucuugguccuggccugauggggcggagcugccguuuacaaucgacaaguga

SEQ ID NO: 200060 - RNA, 1350 nt, Artificial Sequence
  derived and/or modified sequence opt5 from neuraminidase__InfluenzaA__ACT15346
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacaauauuagaaucggcagccgcggggacguguuuguuauucgggagcccuucaucucuuguucccaucucgaaugcagaaccuuuuuccugacacaaggagcccuucugaacgauaagcacagcaauggcaccgugaaagaccggucuccucaucgcacacucauguccugucccgucggcgaggcuccuagccccuauaacucuagauuugaauccguggccuggagcgcuuccgccugccacgaugggaccucuuggcugacgaucggaauuagcggcccugacaauggggcuguugccgugcugaaguacaacggaaucauuaccgauacaaucaaguccuggcggaauaacauuaugcgcacccaggagagcgagugugcgugcgucaauggcucuuguuucacagugaugaccgacgggccguccagcggacaggccucuuauaaaaucuuuaagauggaaaaaggcaagguggucaaaagcguugagcucgaugcucccaacuaccauuaugaagagugcuccuguuacccugacgccggcgagaucacgugcgugugcagagauaacuggcacgggucuaaucggcccugggugagcuucaaccagaaucuggaauaucaaauuggauacaucuguuccggcgucuuuggggacaacccucgccccaaugauggaacaggcagcugcgggccgguguucccuaacggagcuuacggcguuaagggcuuuucuuucaaguaugggaauggaguguggauuggcagaaccaaauccacaaacagccggucuggguuugagaugaucugggaccccaauggauggaccggcaccgacuccagcuucuccgucaagcaggauauuguggccaucacagacuggucuggguacagcggcuccuucguucagcacccugaacuuacgggacuggauuguauccgccccugcuuuuggguggagcucauuagaggccggcccaaagaaucuaccaucuggacaagcggguccagcauuucuuucuguggagucaacggcgacaccguguccuggagcuggccugauggggcggagcugccguuuacaaucgacaaguga

SEQ ID NO: 200061 - RNA, 1350 nt, Artificial Sequence
  derived and/or modified sequence opt5 from neuraminidase__InfluenzaA__ACT15348
augaaccccaaucagaagaucauuaccaucggcagcauuugcauggugaucgggacagucucccugaugcuccaaauuggaaacaugaucucuaucuggguuagccacuccauucagacgggcaaucagugucagggggagccuaucucuaacaccaaauuccugacagaaaaggccguggcuagcgugacccuugccggaaauuccucucugugcccgauuagcggcugggcggucuacuccaaagacaacagcaucagaauugggucucggggagauguguuuguuauccgcgagcccuucauuuccuguagccaucucgaaugcagaacauuuuuccugacccaaggcgcccuucugaaugacaagcacucuaacggcacagugaaagaucgguccccucaucgcacccucaugagcugucccgucggggaggcuccuucucccuauaauuccagauuugaaagcguggccugguccgcuucugccugccacgacggaacgagcuggcugaccaucggcaucuccgggccugauaacggagcuguugccgugcugaaguacaauggcauuaucacagacaccauuaagagcuggcggaacaauauccuccgcacacaggagucugagugugcgugcgucaacggguccuguuucaccgugaugacggauggaccgagcucuggccaggccagcuauaaaauuuuuaagauggaaaaaggcaagguggucaaauccguugagcuggacgcucccaauuaccauuaugaagagugcucuuguuacccugaugccggggagaucacaugcgugugcagagacaacuggcacggaagcaaccggcccuggguguccuucaaucagaaccuugaauaucaaaucggcuacauuuguagcggggucuuuggagauaauccucgccccaacgacggcaccgggucuugcggaccggugguuuccaauggcgcuuacggcgugaagggguucagcuuuaaguauggaaacggcgucuggaucgggagaacaaaaucuaccaauucccggagcggauucgagaugauuugggauccuaacggcuggaccgggacagacuccucuuuuagcggcaagcaggacaucguggccauuacggauugguccggauacucuggcagcuucguucagcaccccgaacugaccgggcucgacuguauccgcccuugcuucuggguggagcugaucagaggacggcccaaagaauccacaauuuggaccagcgggucuuccaucagcuuuuguggcgucaauucugauacaguguccuggagcuggcccgacggagcggagcuuccuuucaccauugauaaguga

SEQ ID NO: 200062 - RNA, 1350 nt, Artificial Sequence
  derived and/or modified sequence opt5 from neuraminidase__InfluenzaA__ACT15350
augaaccccaaucagaagaucauuaccaucggcagcauuugcauggugaucgggauugucucccugaugcuccaaaucggaaacaugaucucuauuuggguuagccacuccauccagacaggcaauagaugucaggacgagccuauuucuaacacgaaauuccugaccgaaaaggccguggcuagcgugacacuugccggaaauuccucucugugcccgaucagcgggugggcggucuacuccaaagauaacagcauucggaucggcucucgcggggacguguuuguuauuagagagcccuucaucuccuguagccaucucgaaugccggaccuuuuuccugacacagggagcccuucugaaugauaagcacucuaacggcaccgugaaagaccgcuccccucauagaacacucaugagcugucccgucggcgaggcuccuucucccuauaauucccgguuugaaagcguggccugguccgcuucugccugccacgaugggaccagcuggcugacgaucggaauuuccggcccugacaacggggcuguugccgugcugaaguacaauggaaucauuaccgauacaaucaagagcuggcgcaacaauauuaugagaacccaagagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugccgggauaacuggcacgggagcaaccgccccuggguguccuucaaucagaaccuggaauauaagauuggauacaucuguagcggcauuuuuggggacaauccuagacccaacgauggaacaggcucuugcgggccggucuucccuaauggagcuuacggcgugaagggcuuuuccuucaaauaugggaacggaguuuggaucggccggaccaagagcacaaauucucgcuccggguuugagaugauuugggaccccaacggauggaccggcaccgacagcuccuucucugugaaacaggauaucgucgccaucacagacuggagcggguacuccggcucuuucgugcaacacccugaacuuacgggacuggauuguauuagacccugcuuuuggguugagcucauccggggccgccccaaggaaagaaccauuuggacaagcggguccagcaucucuuucuguggagugaauggcgacaccgucuccuggagcuggccugauggggcggagcugccguuuacaauugacaaauga

SEQ ID NO: 200063 - RNA, 1350 nt, Artificial Sequence
  derived and/or modified sequence opt5 from neuraminidase__InfluenzaA__ACT15352
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcggaugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauucuccgcacccaggagucugagugugcgugcgucaacggcuccuguuucacagugaugaccgacgggccgagcucuggacaggccagcuauaaaaucuuuaagauggaaaaaggcaagguggucaaauccguugagcuggaugcucccaauuaccauuaugaagagugcucuuguuacccugacgccggcgagaucacgugcgugugcagagauaacuggcacgggagcaaccggcccuggguguccuucaaucagaaccuugaauaucaaauuggauacaucuguagcggcgucuuuggggacaauccucgccccaacgauggaacaggcucuugcgggccggugguuuccaauggagcuuacggcgugaagggcuucagcuuuaaguaugggaacggagucuggauuggcagaaccaaaucuacaaauucccggagcggguucgagaugaucugggacccuaacggauggaccggcaccgacuccucuuuuagcgggaagcaggauauuguggccaucacagacugguccggcuacucugggagcuucguucagcaccccgaacugacgggccucgauuguauccgcccuugcuucuggguggagcugauuagagggcggcccaaagaauccaccaucuggacaagcggaucuuccauuagcuuuuguggcgucaauucugacaccguguccuggagcuggcccgauggggcggagcuuccuuucacaaucgacaaguga

SEQ ID NO: 200064 - RNA, 1350 nt, Artificial Sequence
  derived and/or modified sequence opt5 from neuraminidase__InfluenzaA__ACT15354
augaaccccagccagaagaucauuaccaucggcuccauuugcauggugaucgggauugucucucugaugcuccaaaucggaaauaugaucagcauuuggaucucccacucuauucagacaggcaaccagugucaggacgagccuaucagcaauacgaaauuccugaccgaaaaggccguugcuuccgugacacuugccgggaacucuagccugugcccgauuuccggaugggcgguguacagcaaagauaauucuaucagaauuggcucccgcggggacgucuuugugauccgggagcccuucaucagcuguucucaucucgaaugcagaaccuuuuuccugacacaaggagcccuucugaacgauaagcacuccaauggcaccguuaaagaccggagcccucaucgcacacucaugucuugucccgugggcgaggcuccuucccccuauaacagcagauuugaauccgucgccuggucugcuagcgccugccacgaugggaccuccuggcugacgauuggaaucagcggcccugacaauggggcuguggccguucugaaguacaacggaauuaucaccgauacaauuaagucuuggcggaauaacaucaugcgcacccaggaguccgagugugcgugcgugaauggcagcuguuucacagucaugaccgacgggccgucuagcggacaggccuccuauaaaaucuuuaagauggaaaaaggcaagguggugaaaucugucgagcucgaugcucccaacuaccauuaugaagagugcagcuguuacccugacgccggcgagauuacgugcguuugcagagauaauuggcacggguccaaccggcccugggugagcuucaaccagaaucuggaauaucaaaucggauacauuuguucuggcguguuuggggacaacccucgccccaaugauggaacaggcuccugcgggccggucuucccuaacggagcuuacggcgugaagggcuuuagcuucaaguaugggaauggaguuuggaucggcagaaccaaaucuacaaacucccggagcggguuugagaugauuugggaccccaauggauggaccggcaccgacuccucuuucagcgugaagcaggauaucgucgccaucacagacugguccggguacucuggcagcuucgugcagcacccugaacuuacgggacuggauuguauucgccccugcuuuuggguugagcucaucagaggccggcccaaagaauccaccauuuggacaagcgggucuuccaucagcuucuguggagugaacggcgacaccgucucuugguccuggccugauggggcggagcugccguuuacaauugacaaguga

SEQ ID NO: 200065 - RNA, 1350 nt, Artificial Sequence
  derived and/or modified sequence opt5 from neuraminidase__InfluenzaA__ACT15356
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcggaugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauucuccgcacccaggagucugagugugcgugcgucaacggcuccuguuucacagugaugaccgacgggccgagcucuggacaggccagcuauaaaaucuuuaagauggaaaaaggcaagguggucaaauccguugagcuggaugcucccaauuaccauuaugaagagugcucuuguuacccugacgccggcgagaucacgugcgugugcagagauaacuggcacgggagcaaccggcccuggguguccuucaaucagaaccuugaauaucaaauuggauacaucuguagcggcgucuuuggggacaauccucgccccaacgauggaacaggcucuugcgggccgguguucuccaauggagcuuacggcguuaagggcuuuagcuucaaguaugggaacggaguguggauuggcagaaccaaaucuacaaauucccggagcggguuugagaugaucugggacccuaacggauggaccggcaccgacuccucuuucagcgggaagcaggauauugucgccaucacagacugguccggcuacucugggagcuucgugcagcaccccgaacugacgggccucgauuguauccgcccuugcuuuuggguugagcugauuagagggcggcccaaagaauccaccaucuggacaagcggaucuuccauuagcuucuguggcgucaauucugacaccguguccuggagcuggcccgauggggcggagcuuccuuuuacaaucgacaaguga

SEQ ID NO: 200066 - RNA, 1350 nt, Artificial Sequence
  derived and/or modified sequence opt5 from neuraminidase__InfluenzaA__ACT15358
augaaccccaaucagaagaucauuaccaucggcagcauuugcauggugaucgggauugucucccugaugcuccaaaucggaaacaugaucucuauuuggguuagccacuccauccagacaggcaauagaugucaggacgagccuauuucuaacacgaaauuccugaccgaaaaggccguggcuagcgugacacuugccggaaauuccucucugugcccgaucagcgggugggcggucuacuccaaagauaacagcauucggaucggcucucgcggggacguguuuguuauuagagagcccuucaucuccuguagccaucucgaaugccggaccuuuuuccugacacacggagcccuucugaaugauaagcauucuaacggcaccgugaaagaccgcuccccucacagaacacucaugagcugucccgucggcgaggcuccuucucccuauaauucccgguuugaaagcguggccugguccgcuucugccugccaugaugggaccagcuggcugacgaucggaauuuccggcccugacaacggggcuguugccgugcugaaguacaauggaaucauuaccgauacaaucaagagcuggcgcaacaauauuaugagaacccaggagucugagugugcgugcgucaacggcuccuguuucacagugaugaccgacgggccgagcucuggacaagccagcuauaaaaucuuuaagauggaaaaaggcaagguggucaaauccguugagcucgaugcucccaauuaccacuaugaagagugcucuuguuacccugacgccggcgagaucacgugcgugugccgggauaacuggcacgggagcaaccgccccuggauuuccuucaaucagaaccuggaauauaagaucggauacauuuguagcggcaucuuuggggacaauccuagacccaacgauggaacaggcucuugcgggccggugcuuccuaauggagcuuacggcgucaagggcuucuccuuuaaauaugggaacggaguguggauuggccggaccaagagcacaaauucucgcuccggguucgagaugaucugggaccccaacggauggaccggcaccgacagcuccuuuucuguuaaacaggauaucguggccauuacagacuggagcggguacuccggcucuuucguccagcauccugaacugacgggacucgauuguaucagacccugcuucuggguggagcugauucggggccgccccaaggaaagcaccaucuggacauccgggagcucuauuuccuuuuguggaguuaauggcgacaccgugagcuggucuuggccugauggggcggagcuuccguucacaaucgacaaauga

SEQ ID NO: 200067 - RNA, 1410 nt, Artificial Sequence; identical to SEQ ID NO: 197351
  derived and/or modified sequence opt5 from neuraminidase__InfluenzaA__ACT21515

SEQ ID NO: 200068 - RNA, 1410 nt, Artificial Sequence
  derived and/or modified sequence opt5 from neuraminidase__InfluenzaA__ACT21516
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucgcuuaucugacaaacaccacgauugagaaggaaaucugcccuaaacucgccgaguaccggaauugguccaagccccagugugacauuaccggguucgcgccuuuuucuaaagauaacagcauccgccuguccgcuggaggcgacaucugggugacaagagagcccuaugugucuugcgauccugacaaguguuaccaauucgcccuugggcagggaaccacacugaauaacguccauagcaaugauaccgugcacgaccggacgccguaucgcacacuccugaugaacgaacugggcguucccuuucaucucgggaccaaacaggugugcgucgccugguccucuagcuccugucacgauggaaaggcuuggcugcaugugugcguuacaggcgacgagaagaaugccaccgcuagcuucauuuacaacggcagacuuguggauucuaucgucuccuggagcaaagaaauucugcggacccaggagucugagugugugugcaucaaugggacauguacgguggucaugaccgacggauccgccagcggcaaggcggauacaaaaauucucuuuaucgaagaggggaagaucguucacaccuccacacugucuggaagcgcccaacacguggaagagugcuccugcuauccucgcuaccccggcgugagaugugucugccgggacaacuggaaggggagcaaccgcccuauuguggauaucaauauuaaagacuacucuaucguuuccagcuauguguguucuggacuugucggcgacacccccagaaagaacgauagcuccucuagcucccauugccuggacccgaauaacgaagagggcgggcacggagugaaaggcugggcuuucgaugacgggaaugauguuuggaugggacggacgauuagcgagaagcuccgcucuggcuacgaaacauuuaaagugaucgaggggugguccaacccuaauagcaagcugcagaucaacagacaggucauuguggaccggggaaaucgcucuggcuauuccggcaucuucagcgucgaagggaaauccuguauuaacagaugcuuuuacguggagcugauccggggaagaaaggaagagaaugagguucucuggaccucuaacagcauuguggucuucuguggcaccuccgggacauauggaaccggcucuuggcccgauggggccgacaucaaucugaugccuauuuga

SEQ ID NO: 200069 - RNA, 1410 nt, Artificial Sequence
  derived and/or modified sequence opt5 from neuraminidase__InfluenzaA__ACT21517
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccgagccccagugugacauuaccggguucgccccuuuuucuaaggauaacagcauccgccuguccgcgggaggcgacaucugggugacaagagaacccuaugucucuugcgauccugacaaauguuaccaauucgcucuugggcagggaaccacacugaauaacgugcauagcaaugauaccguucacgaccggacgccguaucgcacacucgugaugaacgagcugggcguccccuuucaucuggggaccaaacaggugugcauugccugguccucuagcuccugucacgauggaaaggccuggcuccauguuugcgugacaggcgacgauaaaaaugcuaccgccagcuucaucuacaacggcagacuggucgacucuauuguguccuggagcaaggaaauccuucggacccaggagucugagugugugugcauuaaugggacauguacggucguuaugaccgauggauccgcuagcggcaaagccgacacaaagauccuguuuaucgaagaggggaaaauugugcacaccuccacacucucuggaagcgcgcaacacguggaagagugcuccugcuauccucgcuaccccggcgucagaugugugugccgggauaacuggaaggggagcaaccgcccuaucguugacauuaauaucaaggacuacucuauuguguccagcuaugucuguucuggacuggccggcgauacccccagaaagaacgacagcuccucuagcucccauugccuugauccgaauaacgaagagggcgggcacggagugaagggcugggcuuucgacgaugggaaugacguuuggaugggacggacgaucagcgagaaacugcgcucuggcuacgaaacauuuaaggugaucgaggggugguccaacccuaauagcaaacuccagauuaacagacaggucaucguggaucggggaaaucgcucuggcuauuccggcauuuucagcgucgaagggaaguccuguaucaacagaugcuuuuacguggagcugauucggggaagaaaagaagagaccgagguucuguggaccucuaauagcaucguggucuucuguggcacauccgggaccuauggaacaggcucuuggcccgacggggccgauauuaaccucaugccuaucuga

SEQ ID NO: 200070 - RNA, 1410 nt, Artificial Sequence; identical to SEQ ID NO: 199762
  derived and/or modified sequence opt5 from neuraminidase__InfluenzaA__ACT21574

SEQ ID NO: 200071 - RNA, 1410 nt, Artificial Sequence; identical to SEQ ID NO: 199762
  derived and/or modified sequence opt5 from neuraminidase__InfluenzaA__ACT21585

SEQ ID NO: 200072 - RNA, 1410 nt, Artificial Sequence; identical to SEQ ID NO: 199762
  derived and/or modified sequence opt5 from neuraminidase__InfluenzaA__ACT22011

SEQ ID NO: 200073 - RNA, 1410 nt, Artificial Sequence; identical to SEQ ID NO: 199762
  derived and/or modified sequence opt5 from neuraminidase__InfluenzaA__ACT22012

SEQ ID NO: 200074 - RNA, 1410 nt, Artificial Sequence; identical to SEQ ID NO: 199762
  derived and/or modified sequence opt5 from neuraminidase__InfluenzaA__ACT22013

SEQ ID NO: 200075 - RNA, 1410 nt, Artificial Sequence; identical to SEQ ID NO: 199762
  derived and/or modified sequence opt5 from neuraminidase__InfluenzaA__ACT22014

SEQ ID NO: 200076 - RNA, 1410 nt, Artificial Sequence; identical to SEQ ID NO: 199752
  derived and/or modified sequence opt5 from neuraminidase__InfluenzaA__ACT22015

SEQ ID NO: 200077 - RNA, 1410 nt, Artificial Sequence
  derived and/or modified sequence opt5 from neuraminidase__InfluenzaA__ACT22016
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuauuacuacgaagagugcuccuguuauccugacucuagcgagauuacaugcgugugcagagauaacuggcauggguccaaucggcccugggugagcuucaaccagaaucuggaauaccagaucggauauauuuguucuggcaucuuuggggacaacccucgccccaaugauaaaaccggauccugcggcccggucagcucuaacggggccaacggagugaagggcuucuccuuuaaguacggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguauucuggcagcuucguccagcaccccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200078 - RNA, 1410 nt, Artificial Sequence; identical to SEQ ID NO: 199762
  derived and/or modified sequence opt5 from neuraminidase__InfluenzaA__ACT22017

SEQ ID NO: 200079 - RNA, 1410 nt, Artificial Sequence; identical to SEQ ID NO: 199762
  derived and/or modified sequence opt5 from neuraminidase__InfluenzaA__ACT22018

SEQ ID NO: 200080 - RNA, 1410 nt, Artificial Sequence; identical to SEQ ID NO: 199752
  derived and/or modified sequence opt5 from neuraminidase__InfluenzaA__ACT22506

SEQ ID NO: 200081 - RNA, 1410 nt, Artificial Sequence; identical to SEQ ID NO: 199762
  derived and/or modified sequence opt5 from neuraminidase__InfluenzaA__ACT22511

SEQ ID NO: 200082 - RNA, 1410 nt, Artificial Sequence; identical to SEQ ID NO: 199762
  derived and/or modified sequence opt5 from neuraminidase__InfluenzaA__ACT33121

SEQ ID NO: 200083 - RNA, 1410 nt, Artificial Sequence; identical to SEQ ID NO: 199762
  derived and/or modified sequence opt5 from neuraminidase__InfluenzaA__ACT33124

SEQ ID NO: 200084 - RNA, 1410 nt, Artificial Sequence; identical to SEQ ID NO: 199762
  derived and/or modified sequence opt5 from neuraminidase__InfluenzaA__ACT33126

SEQ ID NO: 200085 - RNA, 1410 nt, Artificial Sequence; identical to SEQ ID NO: 199752
  derived and/or modified sequence opt5 from neuraminidase__InfluenzaA__ACT35526

SEQ ID NO: 200086 - RNA, 1410 nt, Artificial Sequence; identical to SEQ ID NO: 199762
  derived and/or modified sequence opt5 from neuraminidase__InfluenzaA__ACT36507

SEQ ID NO: 200087 - RNA, 1410 nt, Artificial Sequence; identical to SEQ ID NO: 199762
  derived and/or modified sequence opt5 from neuraminidase__InfluenzaA__ACT36672

SEQ ID NO: 200088 - RNA, 1410 nt, Artificial Sequence; identical to SEQ ID NO: 199762
  derived and/or modified sequence opt5 from neuraminidase__InfluenzaA__ACT36673

SEQ ID NO: 200089 - RNA, 1410 nt, Artificial Sequence; identical to SEQ ID NO: 199762
  derived and/or modified sequence opt5 from neuraminidase__InfluenzaA__ACT36674

SEQ ID NO: 200090 - RNA, 1410 nt, Artificial Sequence; identical to SEQ ID NO: 199762
  derived and/or modified sequence opt5 from neuraminidase__InfluenzaA__ACT36675

SEQ ID NO: 200091 - RNA, 1410 nt, Artificial Sequence; identical to SEQ ID NO: 199762
  derived and/or modified sequence opt5 from neuraminidase__InfluenzaA__ACT36677

SEQ ID NO: 200092 - RNA, 1410 nt, Artificial Sequence
  derived and/or modified sequence opt5 from neuraminidase__InfluenzaA__ACT36678
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccagacagagcguggucuccgugaaacuugcgggaaauucuagccugugcccuguuuccgggugggcuauuuacagcaaggacaacucugugcggaucggcuccaaaggggaugucuuugugauccgcgagccguucauuagcuguucuccccucgaaugcagaaccuuuuuccugacacagggagcccuucugaaugacaagcauuccaacggcaccaucaaagaucggagcccuuaucgcacgcucaugucuugucccauuggcgagguuccuucccccuacaacagcagauuugaauccguggccuggucugcuagcgccugccacgacgggaucaauuggcugaccauuggaaucuccggcccugauaacggggcugucgccgugcugaaguauaauggaaucauuacagacaccaucaagagcuggcggaacaauauucuccgcacacaagagucugagugugcgugcgugaacggcuccuguuucaccgucaugacggaugggccgagcaauggacaggccucuuacaaaaucuuuagaauugaaaagggcaaaaucguuaagagcguggagaugaacgcucccaauuaucauuacgaagagugcuccuguuacccugacucuagcgagaucacaugcgugugccgggauaacuggcacggcuccaaucgccccugggucagcuucaaccagaaucuggaauaucagauuggguacaucuguucuggaauuuuuggcgacaacccuagacccaaugauaaaaccggguccugcggaccggugagcucuaacggcgccaacgggguuaagggauucuccuuuaaguauggcaauggcguguggaucgggcggacaaaaagcauuuccucucgcaacggauucgagaugaucugggacccuaauggcuggaccgggaccgauaacaauuuuagcauuaagcaagacaucgucggaaucaacgaaugguccggcuacucugggagcuucgugcagcaucccgagcuuacaggccuggacuguauuagaccuugcuucuggguugaacucauccggggacgccccaaagagaauacgauuuggaccuccggcagcucuaucuccuuuuguggggugaacagcgauacagucggauggucuuggcccgacggcgcugagcugccuuucaccauugauaaguga

SEQ ID NO: 200093 - RNA, 1410 nt, Artificial Sequence; identical to SEQ ID NO: 199752
  derived and/or modified sequence opt5 from neuraminidase__InfluenzaA__ACT36679

SEQ ID NO: 200094 - RNA, 1410 nt, Artificial Sequence; identical to SEQ ID NO: 199762
  derived and/or modified sequence opt5 from neuraminidase__InfluenzaA__ACT36680

SEQ ID NO: 200095 - RNA, 1410 nt, Artificial Sequence; identical to SEQ ID NO: 199752
  derived and/or modified sequence opt5 from neuraminidase__InfluenzaA__ACT36682

SEQ ID NO: 200096 - RNA, 1410 nt, Artificial Sequence; identical to SEQ ID NO: 199752
  derived and/or modified sequence opt5 from neuraminidase__InfluenzaA__ACT36683

SEQ ID NO: 200097 - RNA, 1410 nt, Artificial Sequence; identical to SEQ ID NO: 199762
  derived and/or modified sequence opt5 from neuraminidase__InfluenzaA__ACT36684

SEQ ID NO: 200098 - RNA, 1410 nt, Artificial Sequence; identical to SEQ ID NO: 199752
  derived and/or modified sequence opt5 from neuraminidase__InfluenzaA__ACT36685

SEQ ID NO: 200099 - RNA, 1410 nt, Artificial Sequence; identical to SEQ ID NO: 199752
  derived and/or modified sequence opt5 from neuraminidase__InfluenzaA__ACT36686

SEQ ID NO: 200100 - RNA, 1410 nt, Artificial Sequence; identical to SEQ ID NO: 199752
  derived and/or modified sequence opt5 from neuraminidase__InfluenzaA__ACT36687

SEQ ID NO: 200101 - RNA, 1410 nt, Artificial Sequence
  derived and/or modified sequence opt5 from neuraminidase__InfluenzaA__ACT36688
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuauaaguacggcaaugggguguggaucggaagaacaaaaagcauuuccucucggaacggcuuugagaugaucugggacccuaauggguggaccggaaccgauaacaauuucagcauuaagcaagacaucgucggcaucaacgaaugguccggguauucuggcagcuuugugcagcaucccgagcuuacaggacuggacuguauucgcccuugcuucuggguugaacucaucagaggccggcccaaagagaauacgauuuggaccuccgggagcucuaucuccuucuguggagugaacagcgauacagucggcuggucuuggcccgacggggcugagcugccuuuuaccauugauaaguga

SEQ ID NO: 200102 - RNA, 1410 nt, Artificial Sequence; identical to SEQ ID NO: 199752
  derived and/or modified sequence opt5 from neuraminidase__InfluenzaA__ACT36689

SEQ ID NO: 200103 - RNA, 1410 nt, Artificial Sequence; identical to SEQ ID NO: 199792
  derived and/or modified sequence opt5 from neuraminidase__InfluenzaA__ACT36690

SEQ ID NO: 200104 - RNA, 1410 nt, Artificial Sequence; identical to SEQ ID NO: 199752
  derived and/or modified sequence opt5 from neuraminidase__InfluenzaA__ACT36691

SEQ ID NO: 200105 - RNA, 1410 nt, Artificial Sequence; identical to SEQ ID NO: 199792
  derived and/or modified sequence opt5 from neuraminidase__InfluenzaA__ACT36693

SEQ ID NO: 200106 - RNA, 1410 nt, Artificial Sequence; identical to SEQ ID NO: 199762
  derived and/or modified sequence opt5 from neuraminidase__InfluenzaA__ACT36694

SEQ ID NO: 200107 - RNA, 1410 nt, Artificial Sequence; identical to SEQ ID NO: 199762
  derived and/or modified sequence opt5 from neuraminidase__InfluenzaA__ACT36695

SEQ ID NO: 200108 - RNA, 1410 nt, Artificial Sequence; identical to SEQ ID NO: 199762
  derived and/or modified sequence opt5 from neuraminidase__InfluenzaA__ACT52684

SEQ ID NO: 200109 - RNA, 1410 nt, Artificial Sequence; identical to SEQ ID NO: 199752
  derived and/or modified sequence opt5 from neuraminidase__InfluenzaA__ACT54608

SEQ ID NO: 200110 - RNA, 1410 nt, Artificial Sequence
  derived and/or modified sequence opt5 from neuraminidase__InfluenzaA__ACT66157
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauucugcgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuuuaaccagaaucuugaauaucagaucggauacauuuguucuggcaucuucggggacaacccucgccccaaugauaaaaccggauccugcggcccggucagcucuaacggggccaacggagugaagggcuuuuccuucaaguauggcaaugggguuuggauuggaagaacaaaaagcaucuccucucggaacggcuuugagaugauuugggacccuaauggguggaccggaaccgauaacaauuucagcaucaagcaagacaucgugggcauuaacgaaugguccggguacucuggcagcuuuguccagcaucccgagcugacaggacucgacuguauccgcccuugcuucuggguggaacugauuagaggccggcccaaagagaauacgaucuggaccuccgggagcucuauuuccuucuguggaguuaacagcgauacagugggcuggucuuggcccgacggggcugagcuuccuuuuaccaucgauaaguga

SEQ ID NO: 200111 - RNA, 1410 nt, Artificial Sequence; identical to SEQ ID NO: 199762
  derived and/or modified sequence opt5 from neuraminidase__InfluenzaA__ACT67117

SEQ ID NO: 200112 - RNA, 1410 nt, Artificial Sequence; identical to SEQ ID NO: 199752
  derived and/or modified sequence opt5 from neuraminidase__InfluenzaA__ACT67121

SEQ ID NO: 200113 - RNA, 1410 nt, Artificial Sequence; identical to SEQ ID NO: 199762
  derived and/or modified sequence opt5 from neuraminidase__InfluenzaA__ACT67240

SEQ ID NO: 200114 - RNA, 1410 nt, Artificial Sequence; identical to SEQ ID NO: 199762
  derived and/or modified sequence opt5 from neuraminidase__InfluenzaA__ACT67241

SEQ ID NO: 200115 - RNA, 1410 nt, Artificial Sequence; identical to SEQ ID NO: 199762
  derived and/or modified sequence opt5 from neuraminidase__InfluenzaA__ACT67243

SEQ ID NO: 200116 - RNA, 1410 nt, Artificial Sequence
  derived and/or modified sequence opt5 from neuraminidase__InfluenzaA__ACT67256
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 200117 - RNA, 1410 nt, Artificial Sequence
  derived and/or modified sequence opt5 from neuraminidase__InfluenzaA__ACT68161
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaagccggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggccgagcugccuuucacaaucgacaaguga

SEQ ID NO: 200118 - RNA, 1410 nt, Artificial Sequence; identical to SEQ ID NO: 199752
  derived and/or modified sequence opt5 from neuraminidase__InfluenzaA__ACT68162

SEQ ID NO: 200119 - RNA, 1410 nt, Artificial Sequence; identical to SEQ ID NO: 199752
  derived and/or modified sequence opt5 from neuraminidase__InfluenzaA__ACT68163

SEQ ID NO: 200120 - RNA, 1410 nt, Artificial Sequence; identical to SEQ ID NO: 199752
  derived and/or modified sequence opt5 from neuraminidase__InfluenzaA__ACT68164

SEQ ID NO: 200121 - RNA, 1410 nt, Artificial Sequence; identical to SEQ ID NO: 199762
  derived and/or modified sequence opt5 from neuraminidase__InfluenzaA__ACT68166

SEQ ID NO: 200122 - RNA, 1410 nt, Artificial Sequence; identical to SEQ ID NO: 199762
  derived and/or modified sequence opt5 from neuraminidase__InfluenzaA__ACT68167

SEQ ID NO: 200123 - RNA, 1410 nt, Artificial Sequence; identical to SEQ ID NO: 199792
  derived and/or modified sequence opt5 from neuraminidase__InfluenzaA__ACT68168

SEQ ID NO: 200124 - RNA, 1410 nt, Artificial Sequence
  derived and/or modified sequence opt5 from neuraminidase__InfluenzaA__ACT68169
augaaccccaaucagaagaucauuaccaucggcagcgugugcaugacaauugggauggccaaccugauccuccaaauuggaaauaucaucuccauuuggaucucucacagcauucagcugggcgaccagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaaugagaccauuaaagacagaagcccuuaucggacgcucaugucuugucccaucggcgaagugccuucccccuacaacagccgcuuugaguccguugccuggucugcuagcgccugccacgaugggauuaacuggcugaccaucggaaucuccggcccugacaauggggcuguggccguccugaaguauaacggaauuaucacagauaccauuaagagcuggagaaauaacauccuccggacacaagagucugaaugugcgugcgugaauggcuccuguuucaccgugaugacggacgggccgagcgauggacaggccucuuacaaaauuuuucgcaucgagaagggcaaaaucgucaagagcguugaaaugaacgcucccaauuaucauuacgaggagugcuccuguuacccugacucuagcgaaauuacaugcgugugcagagauaacuggcacggcuccaaucggcccugggugagcuucaaccagaaucuggaguaucagaucggguacauuuguucuggaaucuuuggcgacaacccucgccccaaugauaaaaccggguccugcggaccggucagcucuaacggcgccaauggggugaagggauucuccuuuaaguauggcaacggcguuuggauugggagaacaaaaagcaucuccucucggaacggauucgaaaugauuugggacccuaauggcuggaccgggaccgacaacaauuuuagcaucaagcaagauaucgugggaauuuccgaguggucuggcuacagcggguccuucguccagcaucccgaacuuacaggccuggacuguauccgcccuugcuucuggguggagcucauuagaggacggcccaaagagaacacgaucuggaccagcgggucuuccauuagcuuuuguggcguuaauucugauacagugggaugguccuggcccgacggcgcugaacugccuuucaccaucgauaaguga

SEQ ID NO: 200125 - RNA, 1410 nt, Artificial Sequence; identical to SEQ ID NO: 199752
  derived and/or modified sequence opt5 from neuraminidase__InfluenzaA__ACT68171

SEQ ID NO: 200126 - RNA, 1410 nt, Artificial Sequence; identical to SEQ ID NO: 199752
  derived and/or modified sequence opt5 from neuraminidase__InfluenzaA__ACT68172

SEQ ID NO: 200127 - RNA, 1410 nt, Artificial Sequence; identical to SEQ ID NO: 199762
  derived and/or modified sequence opt5 from neuraminidase__InfluenzaA__ACT68173

SEQ ID NO: 200128 - RNA, 1410 nt, Artificial Sequence; identical to SEQ ID NO: 199762
  derived and/or modified sequence opt5 from neuraminidase__InfluenzaA__ACT68174

SEQ ID NO: 200129 - RNA, 1410 nt, Artificial Sequence
  derived and/or modified sequence opt5 from neuraminidase__InfluenzaA__ACT68175
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuggggagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguaugggaauggaguguggaucggcagaacaaaauccauuagcucccggaacggguucgagaugaucugggacccuaauggauggaccggcaccgauaacaauuuuucuauuaagcaagacaucgucgggaucaacgaauggagcggcuacuccggaucuuucgugcagcaucccgagcuuacaggccuggacuguauucgcccuugcuucuggguugaacucaucagagggcggcccaaagagaauacgauuuggaccagcggauccagcaucucuuuuuguggcgugaacuccgauacagucggguggagcuggcccgacggagcugagcugccuuucaccauugauaaguga

SEQ ID NO: 200130 - RNA, 1410 nt, Artificial Sequence; identical to SEQ ID NO: 199762
  derived and/or modified sequence opt5 from neuraminidase__InfluenzaA__ACT68176

SEQ ID NO: 200131 - RNA, 1410 nt, Artificial Sequence; identical to SEQ ID NO: 199762
  derived and/or modified sequence opt5 from neuraminidase__InfluenzaA__ACT68177

SEQ ID NO: 200132 - RNA, 1410 nt, Artificial Sequence; identical to SEQ ID NO: 199762
  derived and/or modified sequence opt5 from neuraminidase__InfluenzaA__ACT68178

SEQ ID NO: 200133 - RNA, 1410 nt, Artificial Sequence; identical to SEQ ID NO: 200129
  derived and/or modified sequence opt5 from neuraminidase__InfluenzaA__ACT68179

SEQ ID NO: 200134 - RNA, 1410 nt, Artificial Sequence; identical to SEQ ID NO: 199762
  derived and/or modified sequence opt5 from neuraminidase__InfluenzaA__ACT68180

SEQ ID NO: 200135 - RNA, 1410 nt, Artificial Sequence; identical to SEQ ID NO: 199792
  derived and/or modified sequence opt5 from neuraminidase__InfluenzaA__ACT79145

SEQ ID NO: 200136 - RNA, 1410 nt, Artificial Sequence
  derived and/or modified sequence opt5 from neuraminidase__InfluenzaA__ACT79155
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuggcgggugggcuauuuacuccaaggacaacagcgugagaaucggaucuaaaggcgaugucuuugugauccgggagccguucauuuccuguagccuccuggaaugccgcaccuuuuuccuuacacagggcgcccugcucaaugacaagcauucuaacgggaccaucaaagauagaucccccuaucggacgcugaugagcuguccuauuggagagguucccucuccuuacaacucccgcuuugaaagcguggccugguccgcuucugccugccacgacggcaucaauuggcugaccauugggaucagcggacccgauaacggcgcugucgccgugcucaaguauaaugggaucauuacagacaccaucaaguccuggagaaacaauauucugcggacacaagagagcgagugugcgugcgugaacggaucuuguuucaccgucaugacggauggcccuuccaauggccaggccagcuacaaaaucuuucgcauugaaaaggggaaaaucguuaagucuguggagaugaacgcuccgaauuaucauuacgaagagugcagcuguuaccccgacuccucugagaucacaugcgugugcagagauaacuggcacggaagcaaucggccuugggucuccuucaaccagaaucuugaauaucagauuggcuacaucuguagcgggauuuuuggagacaacccccgcccuaaugauaaaaccggcucuugcgggcccguguccagcaacggagccaacggcguuaagggcuucucuuuuaaguaugggaauggaguguggaucggcagaacaaaauccauuagcucccggaacggguucgagaugaucugggacccgaauggauggaccggcaccgauaacaauuuuucuauuaagcaagacaucgucgggaucaacgaauggagcggcuacuccggaucuuucgugcagcauccugagcugacaggccucgacuguauucgccccugcuucuggguugaacugaucagagggcggccuaaagagaauacgauuuggaccagcggauccagcaucucuuuuuguggcgugaacuccgauacagucggguggagcuggcccgacggagcugagcuucccuucaccauugauaaguga

SEQ ID NO: 200137 - RNA, 1410 nt, Artificial Sequence; identical to SEQ ID NO: 199752
  derived and/or modified sequence opt5 from neuraminidase__InfluenzaA__ACT79165

SEQ ID NO: 200138 - RNA, 1410 nt, Artificial Sequence; identical to SEQ ID NO: 199752
  derived and/or modified sequence opt5 from neuraminidase__InfluenzaA__ACT79175

SEQ ID NO: 200139 - RNA, 1410 nt, Artificial Sequence; identical to SEQ ID NO: 199762
  derived and/or modified sequence opt5 from neuraminidase__InfluenzaA__ACT79185

SEQ ID NO: 200140 - RNA, 1410 nt, Artificial Sequence; identical to SEQ ID NO: 199762
  derived and/or modified sequence opt5 from neuraminidase__InfluenzaA__ACT79622

SEQ ID NO: 200141 - RNA, 1410 nt, Artificial Sequence; identical to SEQ ID NO: 200129
  derived and/or modified sequence opt5 from neuraminidase__InfluenzaA__ACT79630

SEQ ID NO: 200142 - RNA, 1410 nt, Artificial Sequence; identical to SEQ ID NO: 199762
  derived and/or modified sequence opt5 from neuraminidase__InfluenzaA__ACT83798

SEQ ID NO: 200143 - RNA, 1410 nt, Artificial Sequence; identical to SEQ ID NO: 199762
  derived and/or modified sequence opt5 from neuraminidase__InfluenzaA__ACT83808

SEQ ID NO: 200144 - RNA, 1410 nt, Artificial Sequence; identical to SEQ ID NO: 199762
  derived and/or modified sequence opt5 from neuraminidase__InfluenzaA__ACT83818

SEQ ID NO: 200145 - RNA, 1410 nt, Artificial Sequence; identical to SEQ ID NO: 199762
  derived and/or modified sequence opt5 from neuraminidase__InfluenzaA__ACT83828

SEQ ID NO: 200146 - RNA, 1410 nt, Artificial Sequence; identical to SEQ ID NO: 199762
  derived and/or modified sequence opt5 from neuraminidase__InfluenzaA__ACT83838

SEQ ID NO: 200147 - RNA, 1410 nt, Artificial Sequence; identical to SEQ ID NO: 199752
  derived and/or modified sequence opt5 from neuraminidase__InfluenzaA__ACT83848

SEQ ID NO: 200148 - RNA, 1410 nt, Artificial Sequence; identical to SEQ ID NO: 199752
  derived and/or modified sequence opt5 from neuraminidase__InfluenzaA__ACT83858

SEQ ID NO: 200149 - RNA, 1410 nt, Artificial Sequence; identical to SEQ ID NO: 199762
  derived and/or modified sequence opt5 from neuraminidase__InfluenzaA__ACT83868

SEQ ID NO: 200150 - RNA, 1410 nt, Artificial Sequence; identical to SEQ ID NO: 199762
  derived and/or modified sequence opt5 from neuraminidase__InfluenzaA__ACT83878

SEQ ID NO: 200151 - RNA, 1410 nt, Artificial Sequence; identical to SEQ ID NO: 199762
  derived and/or modified sequence opt5 from neuraminidase__InfluenzaA__ACT86002

SEQ ID NO: 200152 - RNA, 1410 nt, Artificial Sequence; identical to SEQ ID NO: 199762
  derived and/or modified sequence opt5 from neuraminidase__InfluenzaA__ACT86012

SEQ ID NO: 200153 - RNA, 1410 nt, Artificial Sequence; identical to SEQ ID NO: 199762
  derived and/or modified sequence opt5 from neuraminidase__InfluenzaA__ACT86022

SEQ ID NO: 200154 - RNA, 1410 nt, Artificial Sequence; identical to SEQ ID NO: 199752
  derived and/or modified sequence opt5 from neuraminidase__InfluenzaA__ACT86032

SEQ ID NO: 200155 - RNA, 1410 nt, Artificial Sequence; identical to SEQ ID NO: 199762
  derived and/or modified sequence opt5 from neuraminidase__InfluenzaA__ACT86042

SEQ ID NO: 200156 - RNA, 1410 nt, Artificial Sequence; identical to SEQ ID NO: 199762
  derived and/or modified sequence opt5 from neuraminidase__InfluenzaA__ACT86052

SEQ ID NO: 200157 - RNA, 1410 nt, Artificial Sequence; identical to SEQ ID NO: 199762
  derived and/or modified sequence opt5 from neuraminidase__InfluenzaA__ACT86062

SEQ ID NO: 200158 - RNA, 1410 nt, Artificial Sequence; identical to SEQ ID NO: 199762
  derived and/or modified sequence opt5 from neuraminidase__InfluenzaA__ACT86072

SEQ ID NO: 200159 - RNA, 1410 nt, Artificial Sequence; identical to SEQ ID NO: 199762
  derived and/or modified sequence opt5 from neuraminidase__InfluenzaA__ACT86082

SEQ ID NO: 200160 - RNA, 1410 nt, Artificial Sequence; identical to SEQ ID NO: 199762
  derived and/or modified sequence opt5 from neuraminidase__InfluenzaA__ACT86092

SEQ ID NO: 200161 - RNA, 1410 nt, Artificial Sequence; identical to SEQ ID NO: 199762
  derived and/or modified sequence opt5 from neuraminidase__InfluenzaA__ACT86102

SEQ ID NO: 200162 - RNA, 1410 nt, Artificial Sequence; identical to SEQ ID NO: 199762
  derived and/or modified sequence opt5 from neuraminidase__InfluenzaA__ACT86112

SEQ ID NO: 200163 - RNA, 1410 nt, Artificial Sequence; identical to SEQ ID NO: 199762
  derived and/or modified sequence opt5 from neuraminidase__InfluenzaA__ACT86122

SEQ ID NO: 200164 - RNA, 1410 nt, Artificial Sequence; identical to SEQ ID NO: 199762
  derived and/or modified sequence opt5 from neuraminidase__InfluenzaA__ACT86132

SEQ ID NO: 200165 - RNA, 1410 nt, Artificial Sequence; identical to SEQ ID NO: 199762
  derived and/or modified sequence opt5 from neuraminidase__InfluenzaA__ACT86142

SEQ ID NO: 200166 - RNA, 1410 nt, Artificial Sequence; identical to SEQ ID NO: 199752
  derived and/or modified sequence opt5 from neuraminidase__InfluenzaA__ACT97323

SEQ ID NO: 200167 - RNA, 1410 nt, Artificial Sequence; identical to SEQ ID NO: 199762
  derived and/or modified sequence opt5 from neuraminidase__InfluenzaA__ACU00934

SEQ ID NO: 200168 - RNA, 1410 nt, Artificial Sequence; identical to SEQ ID NO: 199762
  derived and/or modified sequence opt5 from neuraminidase__InfluenzaA__ACU00944

SEQ ID NO: 200169 - RNA, 1410 nt, Artificial Sequence; identical to SEQ ID NO: 200116
  derived and/or modified sequence opt5 from neuraminidase__InfluenzaA__ACU00954

SEQ ID NO: 200170 - RNA, 1410 nt, Artificial Sequence
  derived and/or modified sequence opt5 from neuraminidase__InfluenzaA__ACU12497
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcccugcgaaccuacaaucauugagagaaauaucaccgaaauuguguaucugacaaacaccacgaucgagcgggaaauuugucccaagcucgucgaguaccgcaauuggagcaaaccucagugcagagugaccggguucgcccccuuuuccaaggacaacucuauccggcugagcgcgggaggcgauauuuggguuacacgcgagccuuauguguccugugacccggggaaaugcuaccaauucgcucuuggacagggcaccacacugaauaacagacauucuaaugauaccguccacgaccggacgcccuaucgcacacuccugaugaacgaacugggggugccuuuucaucucggaaccaagcagguuuguaucgccuggagcuccagcucuugccacgauggcaaggccuggcugcaugugugugucacaggccacgacgagaaugcuaccgccuccuucaucuacgaugggagacuuguggacagcauugugucuugguccaaaaacauccugcggacccaggaaagcgagugcgucuguauuaauggaacaugcacgguugugaugaccgauggcucugcuuccgagcgcgccgacacaaagauccucuuuauugaagaggggaaaaucgugcacaucagcccccuguccggaucugcgcaacaugucgaagagugcagcuguuauccuagauaccccggcgugcggugcguuugucgcgauaacuggaagggguccaacagaccgauuguggacaucaaugucaaagauuacagcauugugucuuccuauguuugcagcggacuugugggcgacaccccucggaagaacgacucuagcuccucuagcuacugucgcaaucccaacaaugaaaagggcucccacggggucaaaggaugggccuucgaugacggcaacgauguguggauggggagaacaaucggagaggagcugcggagcggcuaugaaaccuuuaaggucauugggggauggucuacgccuaauuccaaacuccagacaaacagacaggugaucguugaccgcggcaaucggagcggcuacucugggaucuucuccguggagggaaagagcugcauuaacagauguuuuuaugucgaacugauccgcggccggaaacaggagaccaaggugugguggaccuccaauucuauuguuguguucugcgggacaagcggaaccuacggcacaggguccuggcccgauggcgcugacaucaaccugaugcccauuuga

SEQ ID NO: 200171 - RNA, 1413 nt, Artificial Sequence; identical to SEQ ID NO: 199656
  derived and/or modified sequence opt5 from neuraminidase__InfluenzaA__ACU12508

SEQ ID NO: 200172 - RNA, 1410 nt, Artificial Sequence
  derived and/or modified sequence opt5 from neuraminidase__InfluenzaA__ACU12519
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcaucacaggcgaugacgagaacgcuaccgccagcuucauuuacaauggcagacuuguugauucuguggucuccuggagcaagaaaauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcggccauugccuggacccgaacaaugaggaagggggacacggcgugaaagggugggccuucgaugacggaaacgauguuuggaugggccggacgaucuccgagaagcuccgcagcggguacgagacauuuaaagugaucgaaggauggucuaauccuaacuccaagcugcagauuaauagacaggucaucguggaccggggcaaccgcagcggcuauucugggauuuucuccgucgagggaaaaagcuguaucaauagaugcuuuuacguggaacugauucggggcagaaaccaggagaccgaaguucucuggaccuccaauucuaucguggucuucugugggacaagcggaaccuauggcacaggguccuggcccgauggcgcugacauuaaccugaugccuaucuga

SEQ ID NO: 200173 - RNA, 1410 nt, Artificial Sequence
  derived and/or modified sequence opt5 from neuraminidase__InfluenzaA__ACU12530
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcaacgauaagaaugcuaccgccagcuucaucuacaacggcagacuuguggacucuauugucuccuggagcaaagagauccugcggacccaggaaucugagugugugugcauuaacgggacauguacgguggucaugaccgauggauccgcuagcggcaaggccgacacaaaaauccucuuuaucgaggaagggaagauuguucacaccuccacacugucuggaagcgcgcaacacguggaggaaugcuccugcuauccucgcuaccccggcgugagaugugucugccgggauaauuggaaggggagcaaccgcccuaucguggacauuaauaucaaagauuacucuauuguuuccagcuauguguguucuggacuugucggcgacacccccagaaagaacgacagcuccucuagcucccauugccuggauccgaauaacgaggaaggcgggcacggagugaaaggcugggccuucgacgaugggaaugacguuuggaugggacggacgaucagcgagaagcuccgcucuggcuacgagacauuuaaagugaucgaagggugguccaacccuaauagcaagcugcagauuaacagacaggucaucguggaucggggaaaucgcucuggcuauuccggcauuuucagcgucgaggggaaauccuguaucaacagaugcuuuuacguggaacugauucggggaagaaaggaggaaaccgagguucucuggaccucuaauagcaucguggucuucuguggcacauccgggaccuauggaacaggcucuuggcccgacggggcugauauuaaccugaugccuaucuga

SEQ ID NO: 200174 - RNA, 1410 nt, Artificial Sequence
  derived and/or modified sequence opt5 from neuraminidase__InfluenzaA__ACU12541
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccagcuauguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaagcuccgcucuggcuacgagacauuuaaagugaucgaagggugguccaauccuaacagcaaguggcagauuaauagacaggucaucguggaccggggaaaccgcucuggcuauuccggcauuuucagcgucgaggggaaauccuguaucaauagaugcuuuuacguggaacugauucggggaagaaaggaggaaaccgagguucuguggaccucuaacagcaucguggucuucuguggcacauccgggaccuauggaacaggcucuuggcccgauggggcugacauuaaucucaugccuaucuga

SEQ ID NO: 200175 - RNA, 1410 nt, Artificial Sequence
  derived and/or modified sequence opt5 from neuraminidase__InfluenzaA__ACU12552
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccaguguaacauuaccggguucgccccuuuuucuaaagacaauagcauccgccuguccgcgggaggcgauaucugggugacaagagagcccuaugucucuugcgacccugauaaguguuaccaauucgcucuugggcagggaaccacacugaacaaugugcauagcaacgacaccguucacgaucggacgccguaucgcacacuccugaugaaugaacugggcgugcccuuucaucucgggaccaagcaggucugcauugccugguccucuagcuccugucacgacggaaaagccuggcugcaugugugcguuacaggcgaugacaagaacgcuaccgccagcuucaucuacaauggcagacuuguggauucuauugucuccuggagcaaagagauccugcggacccaggaaucugagugugugugcauuaacgggacauguacgguggucaugaccgacggauccgcuagcggcaaggccgauacaaaaauccucuuuaucgaggaagggaagauuguucacaccuccacacugucuggaagcgcgcaacacguggaggaaugcuccugcuauccucgcuaccccggcgugagaugugucugccgggacaacuggaaggggagcaaucgcccuaucguggauauuaacaucaaagacuacucuauuguuuccggauauguguguagcggccuugucggcgacacccccagaaagaaugauucuagcuccucuagccauugcuccgacccgaacaaugaggaagggggacacggcgugaaagggugggccuucgaugacggaaacgauguuuggaugggccggacgaucagcgagaagcugcgcucuggguacgagacauuuaaagugaucgaaggaugguccaauccuaacagcaagcuccagauuaauagacaggucaucguggaccggggcaaccgcucuggcuauuccgggauuuucagcgucgagggaaaauccuguaucaauagaugcuuuuacguggaacugauucggggcagaaaggaggaaaccgagguucuguggaccucuaacagcaucguggucuucugugggacauccggaaccuauggcacagggucuuggcccgauggcgcugacauuaaucucaugccuaucuga

SEQ ID NO: 200176 - RNA, 1413 nt, Artificial Sequence
  derived and/or modified sequence opt5 from neuraminidase__InfluenzaA__ACU12574
augaaccccaaucagaagaucauuaccaucggcagcauuuccaucgccauugggaucaucaaccugaugcuccaaauuggaaauaucauuucuaucugggcuagccacuccauucagacaggcucucagaacaauacggggaucugcaaccagagaauuaucaccuacgagaauagcacaugggugaaccauaccuaugucaauaucaacaauacaaacguuguggccggagaagacaaaaccuccgugacacuggcgggcaauucuagccuuuguuccauuagcgggugggcuaucuacaccaaggauaacucuauucggaucggauccaaaggcgacgucuucgugauucgcgagccuuuuaucagcugcucucaccuggaauguagaacguucuuucucacccaaggcgcccugcuuaaugauaagcauuccaacgggacaguuaaagaccggagcccguaucgcgcccugaugucuugcccccucggagaggcuccuucccccuacaacagcaaguucgaauccguggccuggucugcuagcgccugucacgauggcaugggguggcugaccaucggaauuuccggcccugacaauggggcggucgccgugcugaaguauaacggaaucauuacaggcaccaucaaaagcuggaagaaacagauucucagaacgcaggagucugagugcguuuguaugaauggcuccugcuuuacaaucaugaccgaugggcccagcaacaaggcugccucuuacaaaaucuucaagauugaaaagggaaaagugacaaagagcaucgagcugaaugcuccuaacuuuuauuacgaagaguguuccugcuacccggacaccggcauugucaugugugugugccgggauaauuggcaugggucuaaccgccccugggugagcuucaaucagaaccuugacuaucaaaucggauacauuugcuccggcgucuuuggggauaauccuagacccgaggacggagaaggcagcuguaacccuguuaccguggauggcgccaauggggugaaaggauucucuuauaaguacgacaacggcgucuggaucgggcggacaaaauccaaucgccugagaaagggauuugagaugauuugggaccccaacggcuggacgaacaccgauagcgacuucucugugaaacaggauguuguggcgaucacagacugguccggguauagcggcuccuuuguccagcacccggaacucaccggacuggauugcauccggccuuguuucuggguggagcuuguucgcggccugcccagagaaaauacaaccauuuggacgucugggagcuccaucucuuucugcggagugaacagcgacacagccaauugguccuggccugauggcgcugagcuccccuuuaccauugacaaguga

SEQ ID NO: 200177 - RNA, 1413 nt, Artificial Sequence; identical to SEQ ID NO: 199656
  derived and/or modified sequence opt5 from neuraminidase__InfluenzaA__ACU12585

SEQ ID NO: 200178 - RNA, 1413 nt, Artificial Sequence
  derived and/or modified sequence opt5 from neuraminidase__InfluenzaA__ACU12596
augaaccccaaucagaagaucauuaccaucggcagcauuuccaucgccauugggaucaucucucugaugcuccaaauuggaagcaucauuuccaucugggcuucucacagcauuagaacaggcucccagaacaauacggggaucugcaaccagcggauuaucaccuacgagaauagcacaugggugaaccauaccuaugucaauaucaacaauacaaacguuguggccggagaagacaaaaagagcgugacccuggcgggcaauuccagccuuuguucuauuuccgggugggcuaucuacacaaaagauaacagcauucgcaucggaucuaagggcgacgucuucgugauuagagagccuuuuaucuccugcagccaccuggaaugucggaccuucuuucucacgcagggcgcccugcuuaaugauaaacauucuaacgggaccguuaaggaccgcuccccguauagagcccugaugagcugcccccucggagaggcuccuucccccuacaauucuaaguucgaaagcguggccugguccgcuagcgccugucacgauggcaugggguggcugacaaucggaauuucuggcccugacaacggggcggucgccgugcugaaauauaacggaaucauuaccggcacaaucaaguccuggaaaaagcaaauucuccggacccaggagagcgagugcguuuguaugaauggcucuugcuuuacgaucaugacagaugggcccagcaacaaagcugccuccuacaagaucuucaagauugaaaaaggaaaggugaccaaaucuaucgagcugaaugcuccuaacuuuuauuacgaagaguguagcugcuacccggacacaggcauugucaugugugugugccgcgauaauuggcauggguccaacagacccugggugagcuucaaucagaaccuugacuaucagaucggauacauuugcucuggcgucuuuggggauaauccucggcccgaggacggagaaggcuccuguaacccuguuaccguggauggcgccaauggggugaagggauucagcuauaaauacggcaacggggucuggaucggacgcaccaagucuaauagacugcggaaaggcuuugagaugauuugggaccccaacggguggacaaauacggacuccgauuucagcgugaagcaagacguuguggcgaucaccgauugguccggcuauucuggaucuuuuguccagcacccggaacucacaggccuggacugcauccgcccuuguuucuggguggagcuuguuagagggcugccccgggaaaacaccacaauuuggaccuccggaucuagcaucuccuucugcggcgugaacagcgauacggccaauuggucuuggccugacggggcugagcuccccuuuacaauugauaaguga

SEQ ID NO: 200179 - RNA, 1410 nt, Artificial Sequence; identical to SEQ ID NO: 199762
  derived and/or modified sequence opt5 from neuraminidase__InfluenzaA__ACU13077

SEQ ID NO: 200180 - RNA, 1410 nt, Artificial Sequence; identical to SEQ ID NO: 199762
  derived and/or modified sequence opt5 from neuraminidase__InfluenzaA__ACU13078

SEQ ID NO: 200181 - RNA, 1410 nt, Artificial Sequence; identical to SEQ ID NO: 199762
  derived and/or modified sequence opt5 from neuraminidase__InfluenzaA__ACU13079

SEQ ID NO: 200182 - RNA, 1410 nt, Artificial Sequence; identical to SEQ ID NO: 199762
  derived and/or modified sequence opt5 from neuraminidase__InfluenzaA__ACU13080

SEQ ID NO: 200183 - RNA, 1410 nt, Artificial Sequence; identical to SEQ ID NO: 199752
  derived and/or modified sequence opt5 from neuraminidase__InfluenzaA__ACU13081

SEQ ID NO: 200184 - RNA, 1410 nt, Artificial Sequence; identical to SEQ ID NO: 199762
  derived and/or modified sequence opt5 from neuraminidase__InfluenzaA__ACU13082

SEQ ID NO: 200185 - RNA, 1410 nt, Artificial Sequence; identical to SEQ ID NO: 199762
  derived and/or modified sequence opt5 from neuraminidase__InfluenzaA__ACU13083

SEQ ID NO: 200186 - RNA, 1410 nt, Artificial Sequence
  derived and/or modified sequence opt5 from neuraminidase__InfluenzaA__ACU13084
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccugugggcgggugggcuauuuacuccaaggacaacagcguuagaaucggaucuaaaggcgauguguuugucauccgggagccguucauuuccuguagcccccucgaaugccgcaccuuuuuccugacacagggcgcccuucugaaugacaagcauucuaacgggaccaucaaagauagauccccuuaucggacgcucaugagcugucccauuggagaggugccuucucccuacaacucccgcuuugaaagcguugccugguccgcuucugccugccacgacggcaucaauuggcugaccauugggaucagcggaccugauaacggcgcuguggccguccugaaguauaaugggaucauuacagacaccaucaaguccuggagaaacaauauucuccggacacaagagagcgagugugcgugcgugaacggaucuuguuucaccgugaugacggauggcccguccaauggccaggccagcuacaaaaucuuucgcauugaaaaggggaaaaucgucaagucuguugagaugaacgcucccaauuaucauuacgaagagugcagcuguuacccugacuccucugagaucacaugcgugugcagagauaacuggcacggaagcaaucggcccuggguguccuucaaccagaaucuggaauaucagauuggcuacaucuguagcgggauuuuuggagacaacccucgccccaaugauaaaaccggcucuugcgggccggucuccagcaacggagccaacggcgugaagggcuucucuuuuaaguaugggaauggaguuuggaucggcagaacaaaauccauuagcucccggaacggguucgagaugaucugggacccuaauggauggaccggcaccgauaacaauuuuucuauuaagcaagacaucguggggaucaacgaauggagcggcuacuccggaucuuucguccagcaucccgagcuuacaggccuggacuguauucgcccuugcuucuggguggaacucaucagagggcggcccaaagagaauacgauuuggaccagcggauccagcaucucuuuuuguggcguuaacuccgauacagugggguggagcuggcccgacggagcugagcugccuuucaccauugauaaguga

SEQ ID NO: 200187 - RNA, 1410 nt, Artificial Sequence; identical to SEQ ID NO: 199762
  derived and/or modified sequence opt5 from neuraminidase__InfluenzaA__ACU16799

SEQ ID NO: 200188 - RNA, 1410 nt, Artificial Sequence; identical to SEQ ID NO: 199762
  derived and/or modified sequence opt5 from neuraminidase__InfluenzaA__ACU16861

SEQ ID NO: 200189 - RNA, 1410 nt, Artificial Sequence; identical to SEQ ID NO: 199762
  derived and/or modified sequence opt5 from neuraminidase__InfluenzaA__ACU16934

SEQ ID NO: 200190 - RNA, 1410 nt, Artificial Sequence; identical to SEQ ID NO: 199762
  derived and/or modified sequence opt5 from neuraminidase__InfluenzaA__ACU16997

SEQ ID NO: 200191 - RNA, 1410 nt, Artificial Sequence; identical to SEQ ID NO: 199762
  derived and/or modified sequence opt5 from neuraminidase__InfluenzaA__ACU17130

SEQ ID NO: 200192 - RNA, 1410 nt, Artificial Sequence; identical to SEQ ID NO: 199762
  derived and/or modified sequence opt5 from neuraminidase__InfluenzaA__ACU17191

SEQ ID NO: 200193 - RNA, 1410 nt, Artificial Sequence
  derived and/or modified sequence opt5 from neuraminidase__InfluenzaA__ACU17262
augaaccccaaucagaagaucauuaccaucggcagcgugugcaugacaauugggauggccaaccugauccuccaaauuggaaauaucaucuccauuuggaucucucacagcauucagcugggcaaccagucccagaucgagacguguaaucaaucugucauuaccuacgaaaacaauacauggguuaaccagaccuaugugaauaucagcaacacaaauuucgcugccgggcaguccguggucucugugaaacuugcgggaaacagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 200194 - RNA, 1410 nt, Artificial Sequence; identical to SEQ ID NO: 199762
  derived and/or modified sequence opt5 from neuraminidase__InfluenzaA__ACU17325

SEQ ID NO: 200195 - RNA, 1410 nt, Artificial Sequence; identical to SEQ ID NO: 199762
  derived and/or modified sequence opt5 from neuraminidase__InfluenzaA__ACU17393

SEQ ID NO: 200196 - RNA, 1410 nt, Artificial Sequence; identical to SEQ ID NO: 199762
  derived and/or modified sequence opt5 from neuraminidase__InfluenzaA__ACU17454

SEQ ID NO: 200197 - RNA, 1410 nt, Artificial Sequence; identical to SEQ ID NO: 199762
  derived and/or modified sequence opt5 from neuraminidase__InfluenzaA__ACU17524

SEQ ID NO: 200198 - RNA, 1410 nt, Artificial Sequence; identical to SEQ ID NO: 200116
  derived and/or modified sequence opt5 from neuraminidase__InfluenzaA__ACU27043

SEQ ID NO: 200199 - RNA, 1413 nt, Artificial Sequence
  derived and/or modified sequence opt5 from neuraminidase__InfluenzaA__ACU27415
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacauucgcgggcaacagcucccuguguagcauuucugggugggcuaucuacaccaaggauaauuccauucggaucggaagcaaaggcgacgucuuugugauucgcgagccuuucaucucuugcucccaccuugaauguagaacguuuuuccugacccaaggcgcccuccugaacgauaagcauagcaaugggacaguuaaagaccggucuccguaucgcgcccuuauguccugcccccugggagaggcuccuagccccuacaacuccaaguuugaaucuguggccuggagcgcuuccgccugucacgauggcaugggguggcucaccaucggaauuagcggcccugacaacggggcggucgccgugcugaaguauaauggaaucauuacaggcaccaucaaaucuuggaagaaacagauucugagaacgcaggaguccgagugcguuuguaugaacggcagcugcuucacaaucaugaccgaugggcccucuaauaaggcugccagcuacaaaaucuuuaagauugaaaagggaaaagugacaaaguccaucgagcucaacgcuccuaauuucuauuacgaagaguguucuugcuacccggacaccggcauugucaugugugugugccgggauaacuggcaugggagcaaucgccccuggguguccuuuaaccagaaucuggacuaucaaaucggauacauuugcagcggcgucuucggggauaacccuagacccgaggacggagaaggcucuuguaauccuguuaccguggauggcgccaacggggugaaaggauuuuccuauaaguacggcaauggggucuggaucggacggacaaaaagcaaccgccuuagaaagggcuucgagaugauuugggaccccaauggguggacgaacaccgacucugauuuuuccgugaaacaggacguuguggcgaucacagauuggagcggcuauuccggaucuuucguccagcacccggaacugaccggccucgacugcauccggccuuguuucuggguggagcugguucgcgggcuucccagagaaaacacaaccauuuggacgagcggauccucuaucagcuuuugcggcgucaauuccgauacagccaacuggagcuggccugacggggcugagcugcccuucaccauugauaaguga

SEQ ID NO: 200200 - RNA, 1413 nt, Artificial Sequence; identical to SEQ ID NO: 200199
  derived and/or modified sequence opt5 from neuraminidase__InfluenzaA__ACU27416

SEQ ID NO: 200201 - RNA, 1410 nt, Artificial Sequence; identical to SEQ ID NO: 199752
  derived and/or modified sequence opt5 from neuraminidase__InfluenzaA__ACU29961

SEQ ID NO: 200202 - RNA, 1410 nt, Artificial Sequence
  derived and/or modified sequence opt5 from neuraminidase__InfluenzaA__ACU29971
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucgucggcaucaacgaaugguccggguacucuggcagcuucgugcagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuugguccgacggggcugagcugcccuucaccauugauaaguga

SEQ ID NO: 200203 - RNA, 1410 nt, Artificial Sequence; identical to SEQ ID NO: 199762
  derived and/or modified sequence opt5 from neuraminidase__InfluenzaA__ACU29981

SEQ ID NO: 200204 - RNA, 1410 nt, Artificial Sequence; identical to SEQ ID NO: 199762
  derived and/or modified sequence opt5 from neuraminidase__InfluenzaA__ACU29991

SEQ ID NO: 200205 - RNA, 1410 nt, Artificial Sequence; identical to SEQ ID NO: 199762
  derived and/or modified sequence opt5 from neuraminidase__InfluenzaA__ACU30001

SEQ ID NO: 200206 - RNA, 1410 nt, Artificial Sequence; identical to SEQ ID NO: 199762
  derived and/or modified sequence opt5 from neuraminidase__InfluenzaA__ACU30021

SEQ ID NO: 200207 - RNA, 1410 nt, Artificial Sequence
  derived and/or modified sequence opt5 from neuraminidase__InfluenzaA__ACU30085
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuaugggaaauucuagccugugcccuguuuccggcugggcgauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggcuuggucugccagcgcuugccacgacggaaucaauuggcugaccauuggcaucuccgggccugauaacggagccgucgcugugcugaaguauaauggcaucauuacagacaccaucaagagcuggagaaacaauauucuccggacacaagagucugagugugccugcgugaacggguccuguuucaccgucaugacggauggaccgagcaauggccaggcgucuuacaaaaucuuucgcauugaaaagggcaaaaucguuaagagcguggagaugaacgcccccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggcuaacggaguuaagggcuucuccuuuaaguauggcaaugggguguggaucggaagaacaaaaagcauuuccucucggaacggcuucgagaugaucugggacccuaauggguggaccggaaccgauaacaauuuuagcauuaagcaagacaucgucggcaucaacgaaugguccggguacucuggcagcuucgugcagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuuggcccgacggggccgagcugccuuucaccauugauaaguga

SEQ ID NO: 200208 - RNA, 1410 nt, Artificial Sequence; identical to SEQ ID NO: 200186
  derived and/or modified sequence opt5 from neuraminidase__InfluenzaA__ACU30095

SEQ ID NO: 200209 - RNA, 1410 nt, Artificial Sequence; identical to SEQ ID NO: 199762
  derived and/or modified sequence opt5 from neuraminidase__InfluenzaA__ACU30105

SEQ ID NO: 200210 - RNA, 1410 nt, Artificial Sequence; identical to SEQ ID NO: 199762
  derived and/or modified sequence opt5 from neuraminidase__InfluenzaA__ACU30114

SEQ ID NO: 200211 - RNA, 1410 nt, Artificial Sequence; identical to SEQ ID NO: 199762
  derived and/or modified sequence opt5 from neuraminidase__InfluenzaA__ACU30123

SEQ ID NO: 200212 - RNA, 1410 nt, Artificial Sequence
  derived and/or modified sequence opt5 from neuraminidase__InfluenzaA__ACU31177
augaaccccaaucagaagaucauuaccaucggcagcgugugcaugacaauugggauggccaaccugauccuccaaauuggaaauaucaucuccauuuggaucucucaccugauucagcuuggcaaccagaaucagaucgagacguguaaccaaagcgucauuaccuacgaaaauaacacauggguuaaucagaccuaugugaacaucuccaauacaaacuucgcugccgggcagucuguggucagcgugaaacuggcgggaaauuccucucucugcccuguuagcggcugggcuauuuacuccaaggacaacagcaucagaaucgggucuaaaggagauguguuugucauucgggagccguucaucuccuguagcccccuggaaugccgcaccuuuuuccuuacacagggcgcccugcucaaugacaagcauucuaacggcaccauuaaagauagauccccuuaucggacgcugaugagcugucccaucggggaggugccuucucccuacaacucccgcuuugaaagcguugccugguccgcuucugccugccacgacggaauuagcuggcugaccaucggcaucuccgggccugauaauggagcuguggccguccucaaguauaacggcauuaucacagacaccauuaagagcuggagaaauaacauccugcggacacaagagucugagugugcgugcgugaauggguccuguuucaccgugaugacggauggaccgagcgacggccaggccucuuacaaaauuuuucgcaucgaaaagggcaaaaucgucaagagcguugagaugaacgcucccaauuaucauuacgaagagugcuccuguuacccugauucuagcgagauuacaugcgugugcagagacaacuggcacggguccaaucggcccugggugagcuucaaccagaaucuugaauaucagaucggauacauuuguucuggcaucuuuggggauaacccucgccccaaugacaaaaccggauccugcggcccggucagcucuaacggggccaauggagugaagggcuucuccuuuaaguauggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguacucuggcagcuucguccagcaucccgagcugacaggacucgauuguauccgcccuugcuucuggguggaacugauuagaggccggcccaaagagaauacgaucuggaccuccgggagcucuauuuccuuuuguggaguuaacagcgacacagugggcuggucuuggcccgauggggcugagcuuccuuucaccaucgacaaguga

SEQ ID NO: 200213 - RNA, 1410 nt, Artificial Sequence; identical to SEQ ID NO: 199762
  derived and/or modified sequence opt5 from neuraminidase__InfluenzaA__ACU31178

SEQ ID NO: 200214 - RNA, 1410 nt, Artificial Sequence; identical to SEQ ID NO: 199752
  derived and/or modified sequence opt5 from neuraminidase__InfluenzaA__ACU31179

SEQ ID NO: 200215 - RNA, 1410 nt, Artificial Sequence; identical to SEQ ID NO: 199752
  derived and/or modified sequence opt5 from neuraminidase__InfluenzaA__ACU31180

SEQ ID NO: 200216 - RNA, 1410 nt, Artificial Sequence; identical to SEQ ID NO: 199752
  derived and/or modified sequence opt5 from neuraminidase__InfluenzaA__ACU31181

SEQ ID NO: 200217 - RNA, 1410 nt, Artificial Sequence; identical to SEQ ID NO: 199762
  derived and/or modified sequence opt5 from neuraminidase__InfluenzaA__ACU31182

SEQ ID NO: 200218 - RNA, 1410 nt, Artificial Sequence; identical to SEQ ID NO: 199792
  derived and/or modified sequence opt5 from neuraminidase__InfluenzaA__ACU31183

SEQ ID NO: 200219 - RNA, 1410 nt, Artificial Sequence; identical to SEQ ID NO: 199762
  derived and/or modified sequence opt5 from neuraminidase__InfluenzaA__ACU31184

SEQ ID NO: 200220 - RNA, 1410 nt, Artificial Sequence; identical to SEQ ID NO: 199752
  derived and/or modified sequence opt5 from neuraminidase__InfluenzaA__ACU31185

SEQ ID NO: 200221 - RNA, 1410 nt, Artificial Sequence; identical to SEQ ID NO: 199752
  derived and/or modified sequence opt5 from neuraminidase__InfluenzaA__ACU31186

SEQ ID NO: 200222 - RNA, 1410 nt, Artificial Sequence; identical to SEQ ID NO: 199752
  derived and/or modified sequence opt5 from neuraminidase__InfluenzaA__ACU31187

SEQ ID NO: 200223 - RNA, 1410 nt, Artificial Sequence; identical to SEQ ID NO: 199752
  derived and/or modified sequence opt5 from neuraminidase__InfluenzaA__ACU31188

SEQ ID NO: 200224 - RNA, 1350 nt, Artificial Sequence
  derived and/or modified sequence opt5 from neuraminidase__InfluenzaA__ACU46645
augaaccccaauaagaaaaucauuaccaucggcagcauuugcauggugacagggauggucucccugaugcuccagaucggaaaccugauuucuaucuggguuagccacuccauccauacgggcaaucaacacaaggccgagccuauuucuaacaccaaucuucugacagagaaaaccguggcuagcgugaagcucgccgggaacuccucucuguguccgaucaauggaugggcggucuacagcaaagacaacuccauuagaaucggcagcaagggggauguguucguuauucgggaacccuuuaucucuugcucccaucuugaaugucgcacauucuuucugacccagggagcucuccugaaugacaagcacagcaacggcacagugaaagauagaucuccucaucggacccugauguccggccccgucggggaggccccuagccccuauaauucucgcuucgaauacguggccugguccgcuagcgccugccacgacagaacgucccggcucaccauuggaaucucuggcccugauaacggggcuguugccgugcugaaguauaauggaaucauuacagacaccaucaaaagcuggcgcaacaauauucuuagaacacaggaguccgagugugcgugcgucaacggcagcuguuuuaccgugaugacggaugggccgucuaacggacaggccucccacaagaucuucaaaauggaaaagggcaagguggucaaaagcguugagcuggacgcucccaauuaccauuaugaagagugcucuuguuacccugaugccggcgagauuacaugcgugugucgggacaacuggcacgggagcaaucgccccuggguguccuuuaaccaaaaucucgaauaucagaucggauacaucugcucuggcgucuucggggauaacccuagacccaaugacggagcuggcagcugcgggccgguguccagcaacggagccuacggcguuaagggcuuuucuuucaaauaugggaauggaguguggauuggccggaccaaguccacaaacagccgcucuggguuugagaugaucugggauccuaauggauggaccgaaaccgacuccagcuucuccgucaaacaggacauuguggcgaucacagauuggucuggcuacagcggguccuuuguucagcaucccgagcugacgggccuugacuguauuagaccuugcuucuggguggaacugauccggggacgccccaaggagucuaccaucuggacaagcggcuccagcauuucuuucuguggggucaacuccgauaccgugggauggagcuggcccgacggcgccgagcucccuuuuacaaucgauaaauga

SEQ ID NO: 200225 - RNA, 1410 nt, Artificial Sequence
  derived and/or modified sequence opt5 from neuraminidase__InfluenzaA__ACU56927
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgacaagggcaaaaucgucaagagcguugaaaugaacgcucccaauuaucauuacgaggaaugcuccuguuacccugauucuagcgagauuacaugcgugugcagagacaacuggcacggguccaaucggcccugggugagcuucaaccagaaucuggaguaucagaucggauacauuuguucuggcaucuuuggggauaacccucgccccaaugacaaaaccggauccugcggcccggucagcucuaacggggccaacggagugaagggcuucuccuuuaaguauggcaaugggguuuggauuggaagaacaaaaagcaucuccucucggaacggcuucgaaaugauuugggauccuaauggguggaccggaaccgacaacaauuuuagcaucaagcaagacaucgugggcauuaacgagugguccggguacucuggcagcuucguccagcaucccgaacuuacaggacuggauuguauccgcccuugcuucuggguggagcucauuagaggccggcccaaagaaaauacgaucuggaccuccgggagcucuauuuccuuuuguggaguuaacagcgacacagugggcuggucuuggcccgauggggcugagcugccuuucaccaucgacaaguga

SEQ ID NO: 200226 - RNA, 1410 nt, Artificial Sequence; identical to SEQ ID NO: 199917
  derived and/or modified sequence opt5 from neuraminidase__InfluenzaA__ACU56934

SEQ ID NO: 200227 - RNA, 1410 nt, Artificial Sequence; identical to SEQ ID NO: 199762
  derived and/or modified sequence opt5 from neuraminidase__InfluenzaA__ACU64791

SEQ ID NO: 200228 - RNA, 1410 nt, Artificial Sequence
  derived and/or modified sequence opt5 from neuraminidase__InfluenzaA__ACU64811
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcaugguguccgucaaacuugcgggaaauucuagccugugcccuguguccggcugggcuauuuacagcaaggacaacucuguuagaaucggguccaaaggagauguguuuaucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcaauggccaggccucuuacaaaauuuuucgcaucgaaaagggcaaaaucgucaagagcguggagaugaacgcucccaauuaucauuacgaagagugcuccuguuacccugacucuagcgagauuacaugcguuugcagagauaacuggcacggguccaaucggcccugggugagcuucaaccagaaucuggaauaucagaucggauacauuuguucuggcaucuuuggggacaacccucgccccaaugauaaaaccggauccugcggcccggugagcucuaacggggccaacggagucaagggcuucuccuuuaaguauggcaaugggguguggauuggaagaacaaaaagcaucuccucucggaacggcuucgagaugauuugggacccuaauggguggaccggaaccgauaacaauuuuagcaucaagcaagacaucguuggcauuaacgaaugguccggguacucuggcagcuucgugcagcaucccgagcuuacaggacuggacuguauccgcccuugcuucugggucgaacucauuagaggccggcccaaagagaauacgaucuggaccuccgggagcucuauuuccuuuuguggagugaacagcgauacaguuggcuggucuuggcccgacggggcugagcugccuuucaccaucgauaaguga

SEQ ID NO: 200229 - RNA, 1410 nt, Artificial Sequence; identical to SEQ ID NO: 199527
  derived and/or modified sequence opt5 from neuraminidase__InfluenzaA__ACU79885

SEQ ID NO: 200230 - RNA, 1410 nt, Artificial Sequence; identical to SEQ ID NO: 197119
  derived and/or modified sequence opt5 from neuraminidase__InfluenzaA__ACU79896

SEQ ID NO: 200231 - RNA, 1410 nt, Artificial Sequence; identical to SEQ ID NO: 197119
  derived and/or modified sequence opt5 from neuraminidase__InfluenzaA__ACU79918

SEQ ID NO: 200232 - RNA, 1410 nt, Artificial Sequence; identical to SEQ ID NO: 197119
  derived and/or modified sequence opt5 from neuraminidase__InfluenzaA__ACU79929

SEQ ID NO: 200233 - RNA, 1413 nt, Artificial Sequence
  derived and/or modified sequence opt5 from neuraminidase__InfluenzaA__ACU79940
augaaccccaaucagaagaucauuaccaucggcagcauuuccaucgugauugggaucaucucucugaugcuccaaauuggaaacaucauuagcaucugggccucccacucuauucagacaggcagccagaaucauacggggaucugcaaccagagaauuaucaccuacgagaauagcacaugggucaaccacaccuauguuaauaucaacaauacaaacgugguggcuggaaaagacaagaccucugucacacuggccggcaauagcucccuuuguagcauuucugggugggcgaucuacaccaaagauaacuccauucggaucggaagcaagggcgacguguucguuauucgcgaaccuuuuaucucuugcucccaucuggaguguagaacguucuuucucacccaaggcgcucugcuuaaugauaaacacagcaacgggacagugaaggaccggucuccguaucgcgcccugauguccugcccccucggagaagccccuagccccuacaauuccaaguucgagucugucgcuuggagcgccuccgcuugucaugauggcaugggguggcugaccaucggaauuagcggcccugacaacggggccguggcgguucugaaauauaacggaaucauuacagaaaccaucaagucuuggaaaaagcggauucucagaacgcaggaguccgagugcgugugugucaauggcagcugcuuuacaaucaugaccgauggccccucuaacggggccgcuagcuacaaaaucuucaagauugaaaagggaaaagugacaaaguccaucgagcugaaugccccuaacucucacuaugaagaguguagcugcuacccggacaccggcaccgugaugugugucugccgcgauaauuggcacggguccaacagacccuggguuagcuuuaaucagaaccuugacuaccagauuggauauaucugcucuggcguguucggggauaauccucggcccaaagacggagagggcuccuguaacccugugacagucgauggcgcugacggggugaagggauuuagcuaccgcuauggcaaugggguuuggauuggaagaacgaaaucuaaccggcugcgcaagggcuucgaaaugaucugggaccccaauggguggaccgauacagacuccgauuuuagcgugaaacaagacgucguggccaugaccgauugguccggcuacucuggauccuucguucagcauccggagcucacaggccuggacugcauuagaccuuguuuuuggguggaacuuguccgggggcgccccagagagaacaccacgaucuggacauccggaucuagcaucuccuucugcggcgugaauagcgauaccgcgaacuggucuuggccugacggggccgaacugcccuucaccauugauaaguga

SEQ ID NO: 200234 - RNA, 1410 nt, Artificial Sequence
  derived and/or modified sequence opt5 from neuraminidase__InfluenzaA__ACU79951
augaaccccaaucagaagaucauuaccaucggcagcgugucccugacaauugagacggucugcuuccucaugcaaaucgccauucuggcuaccacaguuacccuucacuuuaaacagcaugaaugugacucuccugccagcaaccaggugaugccgugcgagcccaucaucauugaaagaaauaucacagagauuguguaccugaacaauaccacaaucgaaaaggagauuuguccugaggucguggaauaucggaacugguccaaaccccagugccaaaucaccggguucgcgccuuuuucuaaggauaauagcauucgccucuccgcuggaggcgacaucuggguuacgagagagcccuacgugucuugugauccugggaaaugcuaucaguucgcccugggacagggcaccacacuugacaacaagcacagcaaugggaccauccaugaucggauuccgcaccgcacacugcucaugaacgaacugggaguccccuuucaucugggcaccaaacagguguguguugccugguccucuagcuccugccacgacggcaaggcuuggcuccacgugugugucacgggggaugacagaaaugccacagcuagcuucaucuacgauggacggcugguggacucuauuggcuccuggagccaaaacauccuucgcacccaggagucugagugcguguguauuaaugggacaugcaccgucguuaugaccgauggauccgccagcggcagagcggacacacggauccuguuuaucaaggaagggaaaauugugcauaucuccccucucucuggaagcgcccagcacauugaggaaugcuccuguuauccccgcuacccugaugugagaugcaucugucgggacaacuggaagggcagcaaucgccccgucauugacaucaacauggaggauuauucuaucgacuccagcuacgugugcucuggccugguuggggauacgccgagaaacgacgauagcuccucuaauagcaacugucgggacccuaauaacgaacgcggaaaucccggcgugaaagggugggcuuucgauaacggagacgaugucuggaugggcagaaccauuuccaaggacagccggucuggguacgagacauuuaaggugaucggaggcugguccaccccuaauagcaaaucucagguuaacagacaagugauugucggcaauaacaauugguccggguauagcggaaucuucuccguggagggcaagucuugcauuaaccgcuguuuuuacgucgaacuuauccgggggagaccccaggagacacgcgugugguggaccagcaauuccauuguuguguucugcggaacgucuggcacauaugggaccggcagcuggcccgauggagccaacaucaauuuuaugccuaucuga

SEQ ID NO: 200235 - RNA, 1410 nt, Artificial Sequence; identical to SEQ ID NO: 199627
  derived and/or modified sequence opt5 from neuraminidase__InfluenzaA__ACU79973

SEQ ID NO: 200236 - RNA, 1413 nt, Artificial Sequence; identical to SEQ ID NO: 199656
  derived and/or modified sequence opt5 from neuraminidase__InfluenzaA__ACU79984

SEQ ID NO: 200237 - RNA, 1410 nt, Artificial Sequence; identical to SEQ ID NO: 199623
  derived and/or modified sequence opt5 from neuraminidase__InfluenzaA__ACU80006

SEQ ID NO: 200238 - RNA, 1410 nt, Artificial Sequence
  derived and/or modified sequence opt5 from neuraminidase__InfluenzaA__ACU80017
augaacaccaaucagagaaucauuacaaucggcacgauuugccugaucguggggauuaucagccuccugcuucaaaucggaaacauuauccugcucuggaugucccacucuauucagaccggcgaaaagagccaucccaaagucuguaaucaguccguuaucacauacgagaacaauaccugggugaaccagacauaugugaauauuucuaacaccaauaucgccgcugggcaaggagucacaccuauuauccuggccggcaacagcucccuuugcccgaucucugggugggcgauuuacagcaaggacaauuccauccggauuggaagcaaaggcgauaucuucgugaugcgcgagcccuuuauuucuuguucccaccuggaaugcagaaccuucuuucucacgcagggcgcucugcugaacgaccggcauagcaaugggaccguuaaggaucgcucuccuuauagaacacucauguccugucccaucggagaggccccuagccccuacaacucucgguucgaauccguggccuggagcgcuuccgccugccacgacggcaugggguggcugaccaucggaauuucuggcccugauaauggggcugucgccgugcuuaaauauaacggaaucauuacagacaccaucaagagcuggcgcaacaagauucugagaacgcaggaguccgaguguguuugcaucaauggcagcuguuuuacaaucaugaccgauggcccgucuaacgggcaggcguccuacaaacucuucaagauggaaaaaggaaagauuauccggagcauugagcuggacgcccccaauuaucauuacgaagagugcucuuguuacccugauacaggcaaaguggucugcgugugccgcgacaacuggcacgcuagcaauagacccuggguguccuuugaucaaaaccuugacuaucagaucggguacauuuguucuggagucuucggcgauaauccucggagcaacgacgggaagggaaauugcggccccguucuguccaacggcgccaauggggugaagggauuuagcuuccgcuauggcaacgggguguggaucggaagaaccaaaucuauuuccagccggucuggcuuugagaugaucugggacccgaauggguggaccgaaacagauuccagcuucuccaugaagcaggacaucauugcucucacggauuggucuggcuacagcggauccuuuguccagcacccugagcugaccggcaugaacuguauccgccccugcuucuggguggaacugauuagagggcaaccuaaagagucuacaaucuggaccagcggauccagcauuucuuucuguggcguuaauuccgggacagccagcuggucuuggcccgacggagcggaucuccccuuuaccaucgacaaguga

SEQ ID NO: 200239 - RNA, 1413 nt, Artificial Sequence; identical to SEQ ID NO: 199656
  derived and/or modified sequence opt5 from neuraminidase__InfluenzaA__ACU80028

SEQ ID NO: 200240 - RNA, 1410 nt, Artificial Sequence; identical to SEQ ID NO: 199623
  derived and/or modified sequence opt5 from neuraminidase__InfluenzaA__ACU80039

SEQ ID NO: 200241 - RNA, 1413 nt, Artificial Sequence; identical to SEQ ID NO: 199740
  derived and/or modified sequence opt5 from neuraminidase__InfluenzaA__ACU80050

SEQ ID NO: 200242 - RNA, 1410 nt, Artificial Sequence; identical to SEQ ID NO: 200173
  derived and/or modified sequence opt5 from neuraminidase__InfluenzaA__ACU80061

SEQ ID NO: 200243 - RNA, 1413 nt, Artificial Sequence; identical to SEQ ID NO: 199656
  derived and/or modified sequence opt5 from neuraminidase__InfluenzaA__ACU80072

SEQ ID NO: 200244 - RNA, 1413 nt, Artificial Sequence; identical to SEQ ID NO: 199656
  derived and/or modified sequence opt5 from neuraminidase__InfluenzaA__ACU80094

SEQ ID NO: 200245 - RNA, 1410 nt, Artificial Sequence; identical to SEQ ID NO: 199627
  derived and/or modified sequence opt5 from neuraminidase__InfluenzaA__ACU80105

SEQ ID NO: 200246 - RNA, 1410 nt, Artificial Sequence; identical to SEQ ID NO: 199627
  derived and/or modified sequence opt5 from neuraminidase__InfluenzaA__ACU80127

SEQ ID NO: 200247 - RNA, 1410 nt, Artificial Sequence; identical to SEQ ID NO: 199627
  derived and/or modified sequence opt5 from neuraminidase__InfluenzaA__ACU80138

SEQ ID NO: 200248 - RNA, 1410 nt, Artificial Sequence; identical to SEQ ID NO: 199623
  derived and/or modified sequence opt5 from neuraminidase__InfluenzaA__ACU80160

SEQ ID NO: 200249 - RNA, 1413 nt, Artificial Sequence; identical to SEQ ID NO: 199656
  derived and/or modified sequence opt5 from neuraminidase__InfluenzaA__ACU80171

SEQ ID NO: 200250 - RNA, 1410 nt, Artificial Sequence; identical to SEQ ID NO: 199536
  derived and/or modified sequence opt5 from neuraminidase__InfluenzaA__ACU80182

SEQ ID NO: 200251 - RNA, 1410 nt, Artificial Sequence
  derived and/or modified sequence opt5 from neuraminidase__InfluenzaA__ACU80193
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuauuguguccuggagcaaagagauccugcgcacacaggaaucugagugugucugcauuaaugggacguguaccguggugaugacagauggauccgcuagcggcaaggccgacaccaaaauccucuuuaucgaggaagggaagauuguccauacauccacccugucuggaagcgcgcaacacguugaggaaugcuccugcuauccuagauaccccggcgugcggugugugugccgcgauaacuggaaggggagcaacagaccuaucgucgacauuaauaucaaagaccacucuauuguguccagcuacguuuguucuggacuugugggcgauacgccccggaagaacgacagcuccucuagcucccauugccuggauccgaauaacgaggaaggcgggcacggagucaaaggcugggccuucgacgaugggaaugacguguggaugggacgcacaaucagcgagaagucuagacucggcuaugagaccuuuaaaguuaucgaagggugguccaacccuaagagcaaacugcagauuaaucgccaggugaucgucgaucggggagacagaucuggcuacuccggcauuuucagcguggaggggaaguccuguaucaaccggugcuuuuaugucgaacugauuagaggacgcaaggaggaaaccgaggugcucuggacaucuaauagcaucguuguguucuguggcaccuccgggacauacggaacgggcucuuggcccgauggggcugacauuaaccugaugccuaucuga

SEQ ID NO: 200252 - RNA, 1410 nt, Artificial Sequence; identical to SEQ ID NO: 199536
  derived and/or modified sequence opt5 from neuraminidase__InfluenzaA__ACU80204

SEQ ID NO: 200253 - RNA, 1413 nt, Artificial Sequence
  derived and/or modified sequence opt5 from neuraminidase__InfluenzaA__ACU80237
augaaccccaaucagaagaucauuaccaucggcagcauuuccaucgccauugggaucaucucucugaugcuccaaauuggaaacaucauuagcaucugggcuucccacucuauucagacaggcaaucagaacaauacggggaucugcaaccagagaauuaucaccuacgagaauagcacaugggugaaccauaccuaugucaauaucaacaauacaaacguuguggccggagaagacaaaaccuccgugacacuggcgggcaauucuagccuuuguuccauuagcgggugggcuaucuacaccaaggauaacucuauucggaucggauccaaaggcgacgucuucgugauucgcgagccuuuuaucagcugcucucaccuggaauguagaacguucuuucucacccaaggcgcccugcuuaaugauaagcauuccaacgggacaguuaaagaccggagcccguaucgcgcccugaugucuugcccccucggagaggcuccuucccccuacaacagcaaguucgaauccguggccuggucugcuagcgccugucacgauggcaugggguggcugaccaucggaauuuccggcccugacaauggggcggucgccgugcugaaguauaacggaaucauuacaggcaccaucaaaagcuggaagaaacagauucucagaacgcaggagucugagugcguuuguaugaauggcuccugcuuuacaaucaugaccgaugggcccagcaacaaggcugccucuuacaaaaucuucaagauugaaaagggaaaagugacaaagagcaucgagcugaaugcuccuaacuuucauuaugaagaguguuccugcuacccggacaccggcauugucaugugugugugccgggauaauuggcacgggucuaaccgccccugggugagcuucaaucagaaccuugacuaccaaaucggauauauuugcuccggcgucuuuggggauaauccuagacccgaggacggagaaggcagcuguaacccuguuaccguggauggcgccaauggggugaaaggauucucuuacaaguaugacaacggcgucuggaucgggcggacaaaauccaaucgccugagaaagggauuugagaugauuugggaccccaacggcuggacgaacaccgauagcgacuucucugugaaacaggauguuguggcgaucacagacugguccggguacagcggcuccuuuguccagcacccggaacucaccggacuggauugcauccggccuuguuucuggguggagcuuguucgcggccugcccagagaaaauacaaccauuuggacgucugggagcuccaucucuuucugcggagugaacagcgacacagccaauugguccuggccugauggcgcugagcuccccuuuaccauugacaaguga

SEQ ID NO: 200254 - RNA, 1410 nt, Artificial Sequence; identical to SEQ ID NO: 199627
  derived and/or modified sequence opt5 from neuraminidase__InfluenzaA__ACU80248

SEQ ID NO: 200255 - RNA, 1410 nt, Artificial Sequence; identical to SEQ ID NO: 199627
  derived and/or modified sequence opt5 from neuraminidase__InfluenzaA__ACU80259

SEQ ID NO: 200256 - RNA, 1413 nt, Artificial Sequence
  derived and/or modified sequence opt5 from neuraminidase__InfluenzaA__ACU80270
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccagcauugucaugugugugugccgggauaacuggcacggcuccaaucgccccugggugagcuucaaccagaaucuugacuaccaaaucggguauauuugcucuggagucuuuggcgauaacccuagacccgaggacggggaaggauccuguaauccuguuaccguggauggcgccaacggcgugaaaggguucagcuacaaguaugacaauggagucuggaucggccggacaaaaucuaaccgccugagaaagggguuugagaugauuugggaccccaauggauggacgaacaccgauuccgacuucagcgugaaacaggauguuguggcgaucacagacugguccggcuacucugggagcuuuguccagcacccggaacucaccggccuggauugcauccggccuuguuucuggguggagcuuguucgcggacugcccagagaaaacacaaccauuuggacguccggcucuagcaucuccuucugcggggugaauagcgacacagccaacuggucuuggccugauggagcugagcuccccuuuaccauugacaaguga

SEQ ID NO: 200257 - RNA, 1413 nt, Artificial Sequence
  derived and/or modified sequence opt5 from neuraminidase__InfluenzaA__ACU80281
augaaccagaaucaaaagaucauuaccaucggcagcauuuccaucgccauugggaucaucucucugaugcuccagauuggaaacaucauuagcaucugggcuucccacucuauucagacaggcagccagaauaacacggggaucugcaaucaaagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagcccuuuaucucuugcucccaccuggaauguagaacguucuuucucacccagggcgcccugcuuaacgauaagcauagcaaugggacaguuaaagaccggucuccuuaucgcgcccugauguccugcccgcucggagaggcucccagcccuuacaacuccaaguucgaaucuguggccuggagcgcuuccgccugucacgauggcaugggguggcugaccaucggaauuagcggccccgacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggccuucuaauaaggcugccagcuacaaaaucuucaagauugaaaagggaaaagugacaaaguccaucgagcugaacgcucccaauuuucauuaugaagaguguucuugcuacccugacaccggcauugucaugugugugugccgggauaacuggcacgggagcaaucgcccguggguguccuucaaccaaaaucuugacuaccagaucggauauauuugcagcggcgucuuuggggauaaccccagaccugaggacggagaaggcucuuguaaucccguuaccguggauggcgccaacggggugaaaggauucuccuacaaguaugacaauggcgucuggaucgggcggacaaaaagcaaccgccugagaaagggauuugagaugauuugggacccuaauggcuggacgaacaccgauucugacuucuccgugaaacaggauguuguggcgaucacagacuggagcggguacuccggcucuuuuguccagcaccccgaacucaccggacuggauugcauccggccguguuucuggguggagcuuguucgcggccugccuagagaaaacacaaccauuuggacgagcggguccucuaucagcuucugcggagucaauuccgacacagccaacuggagcuggcccgauggcgcugagcucccuuuuaccauugacaaguga

SEQ ID NO: 200258 - RNA, 1410 nt, Artificial Sequence
  derived and/or modified sequence opt5 from neuraminidase__InfluenzaA__ACU80303
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacaccguucgggaucgcacgccuuauagaacacuccugaugaaugaacugggcgugccguuucaccucgggaccaagcaggucugcauugccuggucuagcuccagcugucaugacggaaaagccuggcugcacgugugcaucacaggcgaugacaagaacgcuaccgccucuuucauuuacaauggccggcuuguugauuccaucgugagcuggucuaaagagauucugcgcacccaggaauccgagugugucugcaucaacgggacauguacgguggugaugaccgacggaagcgcuuccggcaaggccgauacaaaaauccucuuuauugaggaagggaagaucguccauaccucuacacugagcggauccgcgcaacacguugaggaaugcagcugcuaucccagauacccuggcgugcggugugugugccgcgacaacuggaaggggucuaauagacccauugucgauaucaacauuaaagaccacuccaucgugagcucuuacguuuguagcggacuugugggcgacaccccucggaagaaugauuccucuagcuccagccauugccuggaccccaacaaugaggaaggcgggaacggagucaaaggcugggccuucgaugacgggaaugauguguggaugggacgcacgaucucugagaaguccagacucggcuaugagacauuuaaaguuauugaaggguggagcaacccgaagucuaaacugcagaucaaucgccaggugauugucgaccggggaaacagauccggcuacagcggcaucuucuccguggaggggaagucuuguauuaaucggugcuuuuaugucgaacugaucagaggacgcaaggaggaaaccgaggugcucuggaccagcaacuccauuguuguguucuguggcacaucugggaccuacggaacaggcagcuggccugauggggcugacaucaaucugaugcccaucuga

SEQ ID NO: 200259 - RNA, 1410 nt, Artificial Sequence; identical to SEQ ID NO: 199627
  derived and/or modified sequence opt5 from neuraminidase__InfluenzaA__ACU80314

SEQ ID NO: 200260 - RNA, 1410 nt, Artificial Sequence; identical to SEQ ID NO: 199627
  derived and/or modified sequence opt5 from neuraminidase__InfluenzaA__ACU80325

SEQ ID NO: 200261 - RNA, 1410 nt, Artificial Sequence; identical to SEQ ID NO: 199623
  derived and/or modified sequence opt5 from neuraminidase__InfluenzaA__ACU80336

SEQ ID NO: 200262 - RNA, 1410 nt, Artificial Sequence; identical to SEQ ID NO: 199627
  derived and/or modified sequence opt5 from neuraminidase__InfluenzaA__ACU80347

SEQ ID NO: 200263 - RNA, 1410 nt, Artificial Sequence; identical to SEQ ID NO: 199627
  derived and/or modified sequence opt5 from neuraminidase__InfluenzaA__ACU80358

SEQ ID NO: 200264 - RNA, 1410 nt, Artificial Sequence; identical to SEQ ID NO: 199627
  derived and/or modified sequence opt5 from neuraminidase__InfluenzaA__ACU80369

SEQ ID NO: 200265 - RNA, 1410 nt, Artificial Sequence; identical to SEQ ID NO: 199627
  derived and/or modified sequence opt5 from neuraminidase__InfluenzaA__ACU80380

SEQ ID NO: 200266 - RNA, 1410 nt, Artificial Sequence
  derived and/or modified sequence opt5 from neuraminidase__InfluenzaA__ACU80391
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccauuaucgagaaggaaauuugccccaaacucgcugaguaccggaauuggucuaagccucagugugacaucacgggguucgcccccuuuagcaaagauaacuccauccgccugucugcgggaggcgacauuugggugaccagagagccuuaugucagcugcgaucccgacaaguguuaccaauucgcucuugggcagggaacaacccugaauaacgugcauuccaauaacacaguucgggaucgcaccccuuauagaacgcuccugaugaaugaacugggcgugccguuucaccucgggacaaagcaggucugcaucgccuggucuagcuccagcugucaugacggaaaagccuggcugcacgugugcauuaccggcgaugacaagaacgcuacagccucuuucaucuacaauggccggcuuguugauuccauugugagcuggucuaaagagauccugcgcacccaggaauccgagugugucugcaucaacgggaccuguacaguggugaugacggacggaagcgcuuccggcaaggccgauaccaaaauucucuuuaucgaggaagggaagauuguccauacaucuacccugagcggauccgcgcaacacguugaggaaugcagcugcuaucccagauacccuggcgugcggugugugugccgcgacaacuggaaggggucuaauagacccaucgucgauauuaacaucaaagaccacuccaucgugagcucuuacguuuguagcggacuugugggcgacacaccucggaagaaugauuccucuagcuccagccauugccuggaccccaacaaugaggaaggcgggcacggagucaaaggcugggccuucgaugacgggaacgauguguggaugggacgcaccauuucugagaaguccagacucggcuaugagacguuuaaaguuaucgaaggguggagcaauccgaagucuaaacugcagauuaaccgccaggugaucgucgaccggggaaauagauccggcuacagcggcauuuucuccguggaggggaagucuuguaucaaccggugcuuuuaugucgaacugauuagaggacgcaaggaggaaacagaggugcucuggaccagcaauuccaucguuguguucuguggcaccucugggacauacggaaccggcagcuggccugauggggcugacaucaaccugaugcccauuuga

SEQ ID NO: 200267 - RNA, 1410 nt, Artificial Sequence; identical to SEQ ID NO: 199623
  derived and/or modified sequence opt5 from neuraminidase__InfluenzaA__ACU80402

SEQ ID NO: 200268 - RNA, 1413 nt, Artificial Sequence; identical to SEQ ID NO: 199656
  derived and/or modified sequence opt5 from neuraminidase__InfluenzaA__ACU80413

SEQ ID NO: 200269 - RNA, 1410 nt, Artificial Sequence; identical to SEQ ID NO: 199627
  derived and/or modified sequence opt5 from neuraminidase__InfluenzaA__ACU80427

SEQ ID NO: 200270 - RNA, 1410 nt, Artificial Sequence; identical to SEQ ID NO: 199627
  derived and/or modified sequence opt5 from neuraminidase__InfluenzaA__ACU80438

SEQ ID NO: 200271 - RNA, 1410 nt, Artificial Sequence; identical to SEQ ID NO: 199623
  derived and/or modified sequence opt5 from neuraminidase__InfluenzaA__ACU80461

SEQ ID NO: 200272 - RNA, 1410 nt, Artificial Sequence; identical to SEQ ID NO: 199627
  derived and/or modified sequence opt5 from neuraminidase__InfluenzaA__ACU80603

SEQ ID NO: 200273 - RNA, 1410 nt, Artificial Sequence; identical to SEQ ID NO: 199627
  derived and/or modified sequence opt5 from neuraminidase__InfluenzaA__ACU80614

SEQ ID NO: 200274 - RNA, 1410 nt, Artificial Sequence; identical to SEQ ID NO: 199627
  derived and/or modified sequence opt5 from neuraminidase__InfluenzaA__ACU80625

SEQ ID NO: 200275 - RNA, 1410 nt, Artificial Sequence; identical to SEQ ID NO: 199623
  derived and/or modified sequence opt5 from neuraminidase__InfluenzaA__ACU80636

SEQ ID NO: 200276 - RNA, 1410 nt, Artificial Sequence
  derived and/or modified sequence opt5 from neuraminidase__InfluenzaA__ACU80647
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaaugauacgguucgggaccgcacaccguauagaacccuccugaugaacgaacugggcgugcccuuucaccucgggacaaagcaggucugcaucgccugguccucuagcuccugucaugauggaaaagccuggcugcacgugugcauuaccggcgacgauaagaaugcuaccgccagcuucaucuacaacggccggcuuguugacucuguggucuccuggagcaaagagauucugcgcacacaggaaucugagugugugugcaucaaugggacguguaccguggucaugacagauggauccgcuagcggcaaggccgacaccaaaauucucuuuaucgaggaagggaagaucguucauacauccacccugucuggaagcgcgcaacacguggaggaaugcuccugcuauccuagauaccccggcgugcggugugucugccgcgauaacuggaaggggagcaacagaccuauuguggacaucaauauuaaagaccacucuaucguuuccagcuacguguguucuggacuugucggcgauacgccccggaagaacgacagcuccucuagcucccauugccuggauccgaauaacgaggaaggcgggcacggagugaaaggcugggccuucgacgaugggaaugacguuuggaugggacgcacaauuagcgagaagucuagacucggcuaugagaccuuuaaagugaucgaagggugguccaacccuaagagcaaacugcagaucaaucggcaggucauuguggaucgcggagacagaucuggcuacuccggcaucuucagcgucgaggggaaguccuguauuaaccggugcuuuuauguggaacugaucagaggacgcaaggaggaaaccgagguucucuggacaucuaauagcauuguggucuucuguggcaccuccgggacauacggaacgggcucuuggcccgauggggcugacaucaaccugaugccuauuuga

SEQ ID NO: 200277 - RNA, 1410 nt, Artificial Sequence
  derived and/or modified sequence opt5 from neuraminidase__InfluenzaA__ACU80658
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccaagauuaucgagagaaauauuacagaaaucguguaucugaccaacacaaccauugagaaagaaaucugcccuaagcucgcugaguaccggaauugguccaaaccccagugugacauuacgggguucgccccuuuuucuaaggauaacagcauccgccuguccgcgggaggcgacaucugggugaccagagagcccuaugucucuugcgauccugacaaguguuaccaauucgcucuugggcagggaacaacccugaauaacgugcauagcaaugauacaguucgggaccgcaccccguauagaacgcuccugaugaacgaacugggcgugcccuuucaccucgggacaaaacaggucugcauugccugguccucuagcuccugucaugauggaaaggccuggcugcacgugugcaucaccggcgacgauaaaaaugcuacagccagcuucauuuacaacggccggcuuguugacucuguggucuccuggagcaaggagauccugcgcacccaggaaucugagugugugugcauuaaugggaccuguacaguggucaugacggauggauccgcuagcggcaaagccgacaccaagauccucuuuaucgaggaagggaagauuguucauacauccacccugucuggaagcgcgcaacacguggaggaaugcuccugcuauccuagauaccccggcgugcggugugucugccgcgauaacuggaaagggagcaacagaccuaucguggacauuaauaucaaggaccacucuauuguuuccagcuacguguguucuggacuugucggcgauacaccccggaaaaacgacagcuccucuagcucccauugccuggauccgaauaacgaggaaggcgggcacggagugaagggcugggccuucgacgaugggaaugacguuuggaugggacgcaccaucagcgagaaaucuagacucggcuaugagacguuuaaggugaucgaagggugguccaacccuaaaagcaagcugcagauuaaucggcaggucaucguggaucgcggaaacagaucuggcuacuccggcauuuucagcgucgaggggaaguccuguaucaaucggugcuuuuauguggaacugauuagaggacgcaaagaggaaacagagguucucuggaccucuaacagcaucguggucuucuguggcaccuccgggacauacggaaccggcucuuggcccgacggggcugauauuaaucugaugccuaucuga

SEQ ID NO: 200278 - RNA, 1410 nt, Artificial Sequence; identical to SEQ ID NO: 199536
  derived and/or modified sequence opt5 from neuraminidase__InfluenzaA__ACU80669

SEQ ID NO: 200279 - RNA, 1410 nt, Artificial Sequence; identical to SEQ ID NO: 199623
  derived and/or modified sequence opt5 from neuraminidase__InfluenzaA__ACU80691

SEQ ID NO: 200280 - RNA, 1410 nt, Artificial Sequence; identical to SEQ ID NO: 199627
  derived and/or modified sequence opt5 from neuraminidase__InfluenzaA__ACU80702

SEQ ID NO: 200281 - RNA, 1410 nt, Artificial Sequence; identical to SEQ ID NO: 199627
  derived and/or modified sequence opt5 from neuraminidase__InfluenzaA__ACU80713

SEQ ID NO: 200282 - RNA, 1410 nt, Artificial Sequence; identical to SEQ ID NO: 199623
  derived and/or modified sequence opt5 from neuraminidase__InfluenzaA__ACU80724

SEQ ID NO: 200283 - RNA, 1410 nt, Artificial Sequence; identical to SEQ ID NO: 199536
  derived and/or modified sequence opt5 from neuraminidase__InfluenzaA__ACU80735

SEQ ID NO: 200284 - RNA, 1410 nt, Artificial Sequence; identical to SEQ ID NO: 199623
  derived and/or modified sequence opt5 from neuraminidase__InfluenzaA__ACU80746

SEQ ID NO: 200285 - RNA, 1410 nt, Artificial Sequence
  derived and/or modified sequence opt5 from neuraminidase__InfluenzaA__ACU80757
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaagugguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaaugauaccgugcgggaccgcacgccguauagaacacuccugaugaacgaacugggcguccccuuucaccucgggaccaaacaggugugcaucgccugguccucuagcuccugucaugauggaaaggccuggcugcacguuugcauuacaggcgacgauaagaaugcuaccgccagcuucaucuacaacggccggcuuguggacucugucguguccuggagcaaagagauucugcgcacccaggaaucugagugugugugcaucaaugggacauguacggucguuaugaccgauggauccgcuagcggcaaggccgacacaaaaauucucuuuaucgaggaagggaagaucgugcauaccuccacacugucuggaagcgcgcaacacguggaggaaugcuccugcuauccuagauaccccggcguccggugugugugccgcgauaacuggaaggggagcaacagaccuauuguugacaucaauauuaaagaccacucuaucguguccagcuacgucuguucuggacuugugggcgauacgccccggaagaacgacagcuccucuagcucccauugccuggauccgaauaacgaggaaggcgggcacggaguuaaaggcugggccuucgacgaugggaaugacguguggaugggacgcaccauuagcgagaagucuagacucggcuaugagacauuuaaagucaucgaagggugguccaacccuaagagcaaacugcagaucaaucgccaggugauugucgaucggggaaacagaucuggcuacuccggcaucuucagcguggaggggaaguccuguauuaaucggugcuuuuauguugaacugaucagaggacgcaaggaggaaaccgaggugcucuggaccucuaacagcauugucguguucuguggcacauccgggaccuacggaacaggcucuuggcccgacggggcugauaucaaucugaugccuauuuga

SEQ ID NO: 200286 - RNA, 1410 nt, Artificial Sequence; identical to SEQ ID NO: 200251
  derived and/or modified sequence opt5 from neuraminidase__InfluenzaA__ACU80768

SEQ ID NO: 200287 - RNA, 1410 nt, Artificial Sequence; identical to SEQ ID NO: 199623
  derived and/or modified sequence opt5 from neuraminidase__InfluenzaA__ACU80779

SEQ ID NO: 200288 - RNA, 1410 nt, Artificial Sequence; identical to SEQ ID NO: 199536
  derived and/or modified sequence opt5 from neuraminidase__InfluenzaA__ACU80790

SEQ ID NO: 200289 - RNA, 1410 nt, Artificial Sequence; identical to SEQ ID NO: 199623
  derived and/or modified sequence opt5 from neuraminidase__InfluenzaA__ACU80801

SEQ ID NO: 200290 - RNA, 1410 nt, Artificial Sequence
  derived and/or modified sequence opt5 from neuraminidase__InfluenzaA__ACU81106
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauucuuccggcuacagcggcauuuucuccgucgaggggaagucuuguaucaacagaugcuuuuauguggaacugauucggggaagaaaggaggaaaccgagguucucuggaccagcaauuccaucguggucuucuguggcacaucugggaccuacggaacaggcagcuggcccgauggggcugacauuaaccugaugccuaucuga

SEQ ID NO: 200291 - RNA, 1410 nt, Artificial Sequence; identical to SEQ ID NO: 199917
  derived and/or modified sequence opt5 from neuraminidase__InfluenzaA__ACU87265

SEQ ID NO: 200292 - RNA, 1410 nt, Artificial Sequence; identical to SEQ ID NO: 199762
  derived and/or modified sequence opt5 from neuraminidase__InfluenzaA__ACU87273

SEQ ID NO: 200293 - RNA, 1410 nt, Artificial Sequence; identical to SEQ ID NO: 199762
  derived and/or modified sequence opt5 from neuraminidase__InfluenzaA__ACV04231

SEQ ID NO: 200294 - RNA, 1410 nt, Artificial Sequence; identical to SEQ ID NO: 199762
  derived and/or modified sequence opt5 from neuraminidase__InfluenzaA__ACV04241

SEQ ID NO: 200295 - RNA, 1410 nt, Artificial Sequence; identical to SEQ ID NO: 199762
  derived and/or modified sequence opt5 from neuraminidase__InfluenzaA__ACV04251

SEQ ID NO: 200296 - RNA, 1410 nt, Artificial Sequence; identical to SEQ ID NO: 199762
  derived and/or modified sequence opt5 from neuraminidase__InfluenzaA__ACV04261

SEQ ID NO: 200297 - RNA, 1410 nt, Artificial Sequence; identical to SEQ ID NO: 199762
  derived and/or modified sequence opt5 from neuraminidase__InfluenzaA__ACV04271

SEQ ID NO: 200298 - RNA, 1410 nt, Artificial Sequence
  derived and/or modified sequence opt5 from neuraminidase__InfluenzaA__ACV04281
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucgggaauacaaacuucgcugccggacagucuguggucagcgugaaacuugcgggcaauuccucucugugcccuguuagcgggugggcuauuuacuccaaggacaacagcaucagaaucggaucuaaaggcgauguguuugucauucgggagccguucaucuccuguagcccccucgaaugccgcaccuuuuuccugacacagggcgcccuucugaaugacaagcauucuaacgggaccauuaaagauagauccccuuaucggacgcucaugagcugucccaucggagaggugccuucucccuacaacucccgcuuugaaagcguugccugguccgcuucugccugccacgacggcauuaauuggcugaccaucgggaucagcggaccugauaacggcgcuguggccguccugaaguauaaugggauuaucacagacaccauuaaguccuggagaaacaauauccuccggacacaagagagcgagugugcgugcgugaacggaucuuguuucaccgugaugacggauggcccguccgacggccaggccagcuacaaaauuuuucgcaucgaaaaggggaaaaucgucaagucuguugagaugaaugcucccaacuaucauuacgaagagugcagcuguuacccugauuccucugagauuacaugcgugugcagagacaauuggcacggaagcaaccggcccuggguguccuucaaucagaaccuggaauaucagaucggcuacauuuguagcgggaucuuuggagauaauccucgccccaacgacaaaaccggcucuugcgggccggucuccagcaauggagccaacggcgugaagggcuucucuuuuaaguaugggaacggaguuuggauuggcagaacaaaauccaucagcucccggaauggguucgagaugauuugggauccuaacggauggaccggcaccgacaauaacuuuucuaucaagcaagacaucguggggauuaaugaauggagcggcuacuccggaucuuucguccagcaucccgagcuuacaggccuggauuguauccgcccuugcuucuggguggaacucauuagagggcggcccaaagagaacacgaucuggaccagcggauccagcauuucuuuuuguggcguuaauuccgacacagugggguggagcuggcccgauggagcugagcugccuuucaccaucgacaaguga

SEQ ID NO: 200299 - RNA, 1410 nt, Artificial Sequence; identical to SEQ ID NO: 199762
  derived and/or modified sequence opt5 from neuraminidase__InfluenzaA__ACV04291

SEQ ID NO: 200300 - RNA, 1410 nt, Artificial Sequence; identical to SEQ ID NO: 199762
  derived and/or modified sequence opt5 from neuraminidase__InfluenzaA__ACV04301

SEQ ID NO: 200301 - RNA, 1410 nt, Artificial Sequence; identical to SEQ ID NO: 199762
  derived and/or modified sequence opt5 from neuraminidase__InfluenzaA__ACV04321

SEQ ID NO: 200302 - RNA, 1410 nt, Artificial Sequence; identical to SEQ ID NO: 199762
  derived and/or modified sequence opt5 from neuraminidase__InfluenzaA__ACV04331

SEQ ID NO: 200303 - RNA, 1410 nt, Artificial Sequence; identical to SEQ ID NO: 199762
  derived and/or modified sequence opt5 from neuraminidase__InfluenzaA__ACV04341

SEQ ID NO: 200304 - RNA, 1410 nt, Artificial Sequence; identical to SEQ ID NO: 199762
  derived and/or modified sequence opt5 from neuraminidase__InfluenzaA__ACV04351

SEQ ID NO: 200305 - RNA, 1410 nt, Artificial Sequence; identical to SEQ ID NO: 199762
  derived and/or modified sequence opt5 from neuraminidase__InfluenzaA__ACV04361

SEQ ID NO: 200306 - RNA, 1410 nt, Artificial Sequence; identical to SEQ ID NO: 199762
  derived and/or modified sequence opt5 from neuraminidase__InfluenzaA__ACV04371

SEQ ID NO: 200307 - RNA, 1410 nt, Artificial Sequence; identical to SEQ ID NO: 199762
  derived and/or modified sequence opt5 from neuraminidase__InfluenzaA__ACV04381

SEQ ID NO: 200308 - RNA, 1410 nt, Artificial Sequence; identical to SEQ ID NO: 199762
  derived and/or modified sequence opt5 from neuraminidase__InfluenzaA__ACV04391

SEQ ID NO: 200309 - RNA, 1410 nt, Artificial Sequence; identical to SEQ ID NO: 199762
  derived and/or modified sequence opt5 from neuraminidase__InfluenzaA__ACV04401

SEQ ID NO: 200310 - RNA, 1410 nt, Artificial Sequence; identical to SEQ ID NO: 199752
  derived and/or modified sequence opt5 from neuraminidase__InfluenzaA__ACV04411

SEQ ID NO: 200311 - RNA, 1410 nt, Artificial Sequence; identical to SEQ ID NO: 199762
  derived and/or modified sequence opt5 from neuraminidase__InfluenzaA__ACV04492

SEQ ID NO: 200312 - RNA, 1410 nt, Artificial Sequence; identical to SEQ ID NO: 199762
  derived and/or modified sequence opt5 from neuraminidase__InfluenzaA__ACV04502

SEQ ID NO: 200313 - RNA, 1410 nt, Artificial Sequence; identical to SEQ ID NO: 199752
  derived and/or modified sequence opt5 from neuraminidase__InfluenzaA__ACV04512

SEQ ID NO: 200314 - RNA, 1410 nt, Artificial Sequence
  derived and/or modified sequence opt5 from neuraminidase__InfluenzaA__ACV04522
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggaaaagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaucaaacaggacaucgugggcauuaaugaaugguccggguacucuggcagcuucguccaacaucccgagcuuacaggacuggauuguauccgcccuugcuucuggguggaacucauuagaggccggcccaaggagaacacgaucuggaccuccgggagcucuauuuccuuuuguggaguuaauagcgacacagugggcuggucuuggcccgauggggcugagcugccuuucaccaucgacaaauga

SEQ ID NO: 200315 - RNA, 1410 nt, Artificial Sequence; identical to SEQ ID NO: 199762
  derived and/or modified sequence opt5 from neuraminidase__InfluenzaA__ACV04532

SEQ ID NO: 200316 - RNA, 1410 nt, Artificial Sequence; identical to SEQ ID NO: 199762
  derived and/or modified sequence opt5 from neuraminidase__InfluenzaA__ACV04542

SEQ ID NO: 200317 - RNA, 1410 nt, Artificial Sequence; identical to SEQ ID NO: 199762
  derived and/or modified sequence opt5 from neuraminidase__InfluenzaA__ACV04552

SEQ ID NO: 200318 - RNA, 1410 nt, Artificial Sequence; identical to SEQ ID NO: 199762
  derived and/or modified sequence opt5 from neuraminidase__InfluenzaA__ACV04562

SEQ ID NO: 200319 - RNA, 1410 nt, Artificial Sequence; identical to SEQ ID NO: 199752
  derived and/or modified sequence opt5 from neuraminidase__InfluenzaA__ACV04572

SEQ ID NO: 200320 - RNA, 1410 nt, Artificial Sequence; identical to SEQ ID NO: 199762
  derived and/or modified sequence opt5 from neuraminidase__InfluenzaA__ACV04582

SEQ ID NO: 200321 - RNA, 1410 nt, Artificial Sequence
  derived and/or modified sequence opt5 from neuraminidase__InfluenzaA__ACV04758
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucccuccgaaugccgcaccuuuuuccucacacagggcgcccugcuuaaugacaagcauagcaacggcaccauuaaagauagaucuccuuaucggacgcugauguccugucccaucggggaggugccuagccccuacaacucccgcuuugaaucuguugccuggagcgcuuccgccugccacgacggaauuaauuggcucaccaucggcaucagcgggccugauaacggagcuguggccguccugaaguauaauggcauuaucacagacaccauuaagucuuggagaaacaauauccugcggacacaagaguccgagugugcgugcgugaacgggagcuguuucaccgugaugacggauggaccgucuaauggccaggccagcuacaaaauuuuucgcaucgaaaagggcaaaaucgucaaguccguugagaugaacgcucccaauuaucauuacgaagagugcucuuguuacccugacagcuccgagauuacaugcgugugcagagauaacuggcacgggagcaaucggcccugggugucuuucaaccagaaucucgaauaucagaucggauacauuuguuccggcaucuuuggggacaacccucgccccaaugauaaaaccggaagcugcggcccggucucuuccaacggggccaacggagugaagggcuucagcuuuaaguauggcaaugggguuuggauuggaagaacaaaauccaucucuagccggaacggcuucgagaugauuugggacccuaauggguggaccggaaccgauaacaauuuuuccaucaagcaagacaucgugggcauuaacgaauggucuggguacagcggcuccuucguccagcaucccgagcugacaggacuugacuguauccgcccuugcuucuggguggaacugauuagaggccggcccaaagagaauacgaucuggaccagcgggucuuccauuagcuuuuguggaguuaacucugauacagugggcugguccuggcccgacggggcugagcucccuuucaccaucgauaaguga

SEQ ID NO: 200322 - RNA, 1410 nt, Artificial Sequence; identical to SEQ ID NO: 199752
  derived and/or modified sequence opt5 from neuraminidase__InfluenzaA__ACV33087

SEQ ID NO: 200323 - RNA, 1410 nt, Artificial Sequence; identical to SEQ ID NO: 199762
  derived and/or modified sequence opt5 from neuraminidase__InfluenzaA__ACV33107

SEQ ID NO: 200324 - RNA, 1410 nt, Artificial Sequence; identical to SEQ ID NO: 199762
  derived and/or modified sequence opt5 from neuraminidase__InfluenzaA__ACV33117

SEQ ID NO: 200325 - RNA, 1410 nt, Artificial Sequence; identical to SEQ ID NO: 199762
  derived and/or modified sequence opt5 from neuraminidase__InfluenzaA__ACV33127

SEQ ID NO: 200326 - RNA, 1410 nt, Artificial Sequence; identical to SEQ ID NO: 199762
  derived and/or modified sequence opt5 from neuraminidase__InfluenzaA__ACV33137

SEQ ID NO: 200327 - RNA, 1410 nt, Artificial Sequence; identical to SEQ ID NO: 199762
  derived and/or modified sequence opt5 from neuraminidase__InfluenzaA__ACV33147

SEQ ID NO: 200328 - RNA, 1410 nt, Artificial Sequence
  derived and/or modified sequence opt5 from neuraminidase__InfluenzaA__ACV33157
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccgugggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 200329 - RNA, 1410 nt, Artificial Sequence
  derived and/or modified sequence opt5 from neuraminidase__InfluenzaA__ACV33167
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacaguggauuggucuuggcccgacggcgcugagcugccuuucaccaucgauaaguga

SEQ ID NO: 200330 - RNA, 1410 nt, Artificial Sequence; identical to SEQ ID NO: 199762
  derived and/or modified sequence opt5 from neuraminidase__InfluenzaA__ACV33177

SEQ ID NO: 200331 - RNA, 1410 nt, Artificial Sequence
  derived and/or modified sequence opt5 from neuraminidase__InfluenzaA__ACV41993
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagauuuguaaccaauccgucaucacguacgaaaauaacaccuggguuaaucagacauaugugaacauuucuaauaccaacuucgcugccgggcagagcguggucuccgugaaacuugcgggaaauucuagccugugcccuguuggcgggugggcuaucuacuccaaggacaacagcgugagaaucggaucuaaaggcgaugucuuugugauucgggagccguucaucuccuguagcccccucgaaugccgcacauuuuuccugacccagggcgcccuucugaaugacaagcauucuaacgggacaauuaaagauagauccccuuaucggacccucaugagcugucccaucggagagguuccuucucccuacaacucccgcuuugaaagcguggccugguccgcuucugccugccacgacggcauuaauuggcugacgaucgggaucagcggaccugauaacggcgcugucgccgugcugaaguauaaugggauuaucaccgacacaauuaaguccuggagaaacaauauccuccggacccaagagagcgagugugcgugcgugaacggaucuuguuucacagucaugaccgauggcccguccaauggccaggccagcuacaaaauuuuucgcaucgaaaaggggaaaaucguuaagucuguggagaugaacgcucccaauuaucauuacgaagagugcagcuguuacccugacuccucugagauuacgugcgugugcagagauaacuggcacggaagcaaucggcccugggucuccuucaaccagaaucuggaauaucagaucggcuacauuuguagcgggaucuuuggagacaacccucgccccaaugauaaaacaggcucuugcgggccgguguccagcaacggagccaacggcguuaagggcuucucuuuuaaguaugggaauggaguguggauuggcagaaccaaauccaucagcucccggaacggguucgagaugauuugggacccuaauggauggacaggcaccgauaacaauuuuucuaucaagcaagacaucgucgggauuaacgaauggagcggcuacuccggaucuuucgugcagcaucccgagcuuaccggccuggacuguauccgcccuugcuucuggguugaacucauuagagggcggcccaaagagaauacaaucuggacgagcggauccagcauuucuuuuuguggcgugaacuccgauaccgucggguggagcuggcccgacggagcugagcugccuuucacaaucgauaaguga

SEQ ID NO: 200332 - RNA, 1410 nt, Artificial Sequence; identical to SEQ ID NO: 199762
  derived and/or modified sequence opt5 from neuraminidase__InfluenzaA__ACV42010

SEQ ID NO: 200333 - RNA, 1410 nt, Artificial Sequence; identical to SEQ ID NO: 199762
  derived and/or modified sequence opt5 from neuraminidase__InfluenzaA__ACV42020

SEQ ID NO: 200334 - RNA, 1410 nt, Artificial Sequence; identical to SEQ ID NO: 199527
  derived and/or modified sequence opt5 from neuraminidase__InfluenzaA__ACV49504

SEQ ID NO: 200335 - RNA, 1362 nt, Artificial Sequence
  derived and/or modified sequence opt5 from neuraminidase__InfluenzaA__ACV49537
augaaccccaaucagaagaucauuaccaucggcagcauuugcaugguggucgggaucauuucccugauccuccaaaucggaaacauuaucucuauuuggaucagccacuccauucagacaggcaaucagaaccauacggggaucuguaaucagggaauuaucaccuacaacguuguggccggccaagacucuacaagcgugauccugaccggaaauuccucucuuugcccuauuagagggugggcuauccacagcaaagauaacggcauucggaucggcuccaagggggacgucuucgugauucgcgagccguuuaucagcuguucucaucuggaaugcagaacauucuuucucacccagggagcccugcuuaaugauaaacacuccaacggcgcgguuaaggaccggagccccuaucgcgcucugaugucuuguccugugggggaggcccccuccccuuacaauagcagauucgaaucugucgccugguccgcuagcgccugccaugauggaaugggcuggcucacaaucgggauuuccggacccgacaacggcgcuguggccguucugaaauauaauggcaucauuaccgagacgaucaagucuuggcggaagaaaauucugcgcacccaggaaagcgaguguacaugcgugaacggguccuguuuuaccaucaugacagauggaccuagcgacggccucgcgucuuacaagaucuucaaaauugagaaggggaaagucaccaaguccaucgaacugaaugccccgaacagccacuaugaggaaugcucuuguuaccccgauacgggaaaggugaugugcgugugcagagacaacuggcacggcagcaaucggccuugggucuccuuugaucagaaccuugacuaucaaauuggguacaucuguucuggaguuuucggcgauaauccccgcccuaaagacggcacagggagcugcggacccguguccgcugacggcgccaacggggugaagggauuuagcuacagauauggcaauggggucuggauuggccggaccaaaucugauuccagccgccauggauucgagaugaucugggacccgaacggcuggacagagaccgauucuagauuuuccgugcggcaggacguuguggcuaugaccgaucgcagcggguacuccggaucuuucguccagcacccugaacugacaggccucgacuguaugagacccugcuuuuggguggagcugauucgggggagaccugaagagaagacgaucuggaccagcggauccaucauuucuuucuguggcguuaauagcgauacaguggacugguccuggcccgauggggccgaacuucccuucaccaucgacaaauga

SEQ ID NO: 200336 - RNA, 1362 nt, Artificial Sequence
  derived and/or modified sequence opt5 from neuraminidase__InfluenzaA__ACV49559
augaaccccaaucagaagaucauuaccaucggcagcauuugcaugguggucgggaucauuucccugauccuccaaaucggaaacauuaucucuauuuggaucagccacuccauucaggccggcucuagcacauggguuaaucagacguacgugaacaucuccaauaccaacguggucgcugggcaggacgccacaucugugauucugaccggaaauagcucccuuuguccuaucagaggcugggcgaucuauagcaaagauaacgggauucggaucggaucuaagggcgacauuuucguuauccgcgagccguuuauuuccugcagccaucuggaauguagagcuuucuuucucacacaaggcgcccugcuuaaugauaaacacucuaacgggaccgugaaggaccggucccccuaccgcgcccugaugagcugcccugucggagaggcucccucuccuuauaauuccagauucgaaagcguggccugguccgcuucugccugucaugauggcaugggguggcucacaaucggaaucagcggccccgacaacggggcgguugccgugcugaaauacaauggaauuaucaccgagacgauuaaguccuggcggaagaaaauccugcgcacccaggaaagcgagugcgcuugugucaacggcucuugcuuuacaauuaugaccgauggcccuuccgacgggccggccagcuauaagaucuucaaaaucgagaagggaaaagugacaaagucuauugaacucgaugcucccaauagccacuacgaggaauguuccugcuauccugacaccggcaaggugaugugugucugcagagauaacuggcaugggucuaaccggcccuggguuagcuuugaccagaaucuggauuaccagaucggauacauuugcuccggcguguucggggacacgccucgccccaaagacggaacaggcagcuguggcccggugucugucgauggggccaacggagugaagggcuuuuccuauagauacggggacggaguuuggaucggccggaccaaaagccaaucuucccgccacggguucgagaugauuugggauccuaauggcuggacagagaccgacagcagauuuuccgugcggcaggaugucguggcgaucaccgacuggucuggauauagcggcuccuucguucagcaccccgaacuuacagggcuggauugcaugcgcccuuguuuuuggguggagcucauuagaggacagcccaaggagaaaacgaucuggaccucuggcagcuccaucagcuucugcggggucaacucugacacaguggauugguccuggcccgacggagccgaacugccuuucaccauugauaaguga

SEQ ID NO: 200337 - RNA, 1395 nt, Artificial Sequence
  derived and/or modified sequence opt5 from neuraminidase__InfluenzaA__ACV49570
augaaccccaaucagaagaucauuaccaucggcagcauuugcaugguggucgggaucauuucccugauccuccaaaucggaaacauuguuucuaucuggauuagccacuccauccagacaggcaaucagaaccauacggggaccugugaccagucuauuaucacauacaaaaauagcaccugggugaaccaaacauaugugaaugucguggccggaaaggauaccacauccguuauucuggcuggcaacucuagccuuugcccuaucagagggugggccaucuacuccaaagacaauggagugcggauuggcagcaagggcgaugucuucgugauccgcgagccguuuauuucuuguucccaccuggaaugcagaaccuucuuucucacgcagggggcgcugcuuaacgacaaacauagcaauggaaccguuaaggaucggucucccuaucgcgcucugauguccuguccugugggcgaggcccccagcccuuacaacucuagauucgaauccgucgccuggagcgcuuccgccugccacgacgggaugggauggcucacaaucggcauuucugggcccgaugacggagcuguggccgugcugaaguauaauggcaucaucaccgagacaauuaaaagcuggcggaaggaaauccugcgcacccaggaguccgagugugucugcguuaacggcagcuguuuuacgauuaugacagaugggccuucuggaggcccggcguccuacaaaaucuucaagauugaaaaagggaaggugaccaagagcaucgagcucgacgcccccaauucucauuaugaagagugcagcuguuacccugauacauccaaagugaugugcgucugcagagacaacuggcacggaucuaaccggcccugggugagcuuugaucagaaucuggacuaccaaaugggcuauaucuguuccgggguuuucggagacaacccucgccccaaggauggcaaaggcagcugcgggccgguguacgucgacggagcuaauggcgugaagggguuuucuuauaaauacggaaacggcguuuggauugggagaaccaaguccaauagcucucggcagggcuucgagaugaucugggauccuaacggauggaccgaaacagacuccaacuuuuucacgaaacaggauguggucgccgugaccgacuggagcggcuauuccgggucuuuuguccagcaccccgagcuuacaggacuggauuguaugcgcccuugcuucuggguggaacucauuagaggccggcccaaggagaauaccaucuggacaagcggguccucuauuagcuucuguggaguuaauuccgacaccguggauuggagcuggcccgacggcgcugaacugccuuuuacgaucgauaaguga

SEQ ID NO: 200338 - RNA, 1410 nt, Artificial Sequence; identical to SEQ ID NO: 199428
  derived and/or modified sequence opt5 from neuraminidase__InfluenzaA__ACV49581

SEQ ID NO: 200339 - RNA, 1410 nt, Artificial Sequence; identical to SEQ ID NO: 199428
  derived and/or modified sequence opt5 from neuraminidase__InfluenzaA__ACV49592

SEQ ID NO: 200340 - RNA, 1410 nt, Artificial Sequence
  derived and/or modified sequence opt5 from neuraminidase__InfluenzaA__ACV49603
augaaccccaaucagaagaucauuaccaucggcagcgugucccugacaauugagacggucugcuuccucaugcaaaucgccauucuggcuaccacaguuacccuucacuuuaaacagcaugaaugugacucuccugccagcaaccaggugaugccgugcgagcccaucaucauugaaagaaauaucacagagauuguguaccugaacaauaccacaaucgaaaaggagauuuguccugaggucguggaauaucggaacugguccaaaccccagugccaaaucaccggguucgcgccuuuuucuaaggauaauagcauucgccucuccgcuggaggcgacaucuggguuacgagagagcccuacgugucuugugauccugggaaaugcuaucaguucgcccugggacagggcaccacacuugacaacaagcacagcaaugggaccauccaugaucggauuccgcaccgcacacugcucaugaacgaacugggaguccccuuucaucugggcaccaaacagguguguguugccugguccucuagcuccugccacgacggcaaggcuuggcuccacgugugugucacgggggaugacagaaaugccacagcuagcuucaucuacgauggacggcugguggacucuauuggcuccuggagccaaaacauccuucgcacccaggagucugagugcguguguauuaaugggacaugcaccgucguuaugaccgauggauccgccagcggcagagcggacacacggauccuguuuaucaaggaagggaaaauugugcauaucuccccucucucuggaagcgcccagcacauugaggaaugcuccuguuauccccgcuacccugaugugagaugcaucugucgggacaacuggaagggcagcaaucgccccgucauugacaucaacauggaggauuauucuaucgacuccagcuacgugugcucuggccugguuggggauacgccgagaaacgacgauagcuccucuaauagcaacugucgggacccuaauaacgaacgcggaaaucccggcgugaaagggugggcuuucgauaacggagacgaugucuggaugggcagaaccauuuccaaggacagccggucuggguacgagacauuuaaggugaucggaggcugguccaccccuaauagcaaaucucagguuaacagacaagugauugucgauaauaacaauugguccggcuauagcgggaucuucuccguggagggaaagucuugcauuaaccgcuguuuuuacgucgaacuuauccggggcagaccccaggagacacgcgugugguggaccagcaauuccauuguuguguucugcgggacgucuggaacauauggcaccgggagcuggcccgacggcgccaacaucaauuuuaugccuaucuga

SEQ ID NO: 200341 - RNA, 1410 nt, Artificial Sequence
  derived and/or modified sequence opt5 from neuraminidase__InfluenzaA__ACV49625
augaaccccaaucagaagaccaucacaauuggcagcgugucccugacgaucgagaccgucugcuuccucaugcaaauugccauccuggcuacaaccguuacacuucacuuuaaacagcaugaaugugacucuccugccagcaaccaggugaugccgugcgagcccauuaucaucgaaagaaauauuaccgagaucguguaccugaacaauacaaccauugaaaaggagaucuguccugaggucguggaauaucggaacugguccaaaccccagugccaaauuacgggguucgcgccuuuuucuaaggauaauagcauccgccucuccgcuggaggcgacauuuggguuaccagagggcccuacgugucuugugauccuggaaaaugcuaucaguucgcccugggccaggggacaacccuugacaacaagcacagcaauggaacaauccaugaucggaucccgcaccgcacccugcucaugaacgagcugggcguccccuuucaucugggcacgaaacagguguguguugccugguccucuagcuccugccacgacgggaaggcuuggcuccacgugugugucacaggagaugacagaaaugccaccgcuagcuucauuuacgauggccggcugguggacucuaucggguccuggagccaaaacauucuucgcacacaggaaucugagugcguguguaucaauggaaccugcaccgucguuaugacagauggcuccgccagcgggagagcggacacgcggauucuguuuaucaaggagggaaaaaucgugcauauuuccccucucucuggcagcgcccagcacaucgaagagugcuccuguuauccccgcuacccugaugugagaugcauuugucgggacaacuggaagggcagcaaucgccccgucaucgacauuaacauggaagauuauucuaucgacuccagcuacgugugcucugggcugguuggagauaccccgagaaacgacgauagcuccucuaauagcaacugucgggacccuaauaacgagcgcggcaaucccggggugaaaggaugggcuuucgauaacggcgacgaugucuggauggggagaacaaucuccaaggacagccggucuggauacgaaaccuuuaaggugauuggcggcugguccacaccuaauagcaaaucucagguuaacagacaagugaucgucgauaauaacaauugguccggguauagcggaauuuucuccguggagggcaagucuugcaucaaccgcuguuuuuacgucgagcuuauucgggggagaccccaggaaacccgcgugugguggacgagcaauuccaucguuguguucugcggaacaucuggcaccuaugggaccggcagcuggcccgacggagccaacauuaauuuuaugccuaucuga

SEQ ID NO: 200342 - RNA, 1410 nt, Artificial Sequence; identical to SEQ ID NO: 199480
  derived and/or modified sequence opt5 from neuraminidase__InfluenzaA__ACV49647

SEQ ID NO: 200343 - RNA, 1413 nt, Artificial Sequence
  derived and/or modified sequence opt5 from neuraminidase__InfluenzaA__ACV49669
augaaccccaaucagaagaucauuaccaucggcagcauuugcauggccaucgggauuaucucccugauccuccaaauuggaaacaucgugucuauuuggaucagccacuccauucagacaggcucucagaauuacacggggaucuguaaccagagaauuaucaccuaugagaauagcacaugggucaaccaaaccuacguuaauaucaacaauacaaacgugguggcuggacaggacaccacauccgucacccuggccggcaauucuagccuuugcccuauuuccgggugggcgaucuauagcaaagauaacucuauucggaucggauccaagggcgacguguucguuauucgcgaaccguuuaucagcuguucucaucuggagugcagaacguucuuucucacccagggcgcucugcuuaaugauaaacacuccaacgggacagugaaggaccggagccccuaccgcgcccugaugucuuguccuaucggagaagcccccuccccuuauaauagcagauucgaguccgucgcuuggucugccagcgcuugccaugauggcaugggguggcucaccauuggaaucuccggccccgacgauggggccguggcgguucugaaauacaacggaauuaucacagaaaccauuaagagcuggcggaagcgcauccugagaacgcaggagucugagugugugugcgucaacggcuccuguuuuacaaucaugaccgacggcccuaauaacgggccggccagcuauaaaauuuucaagaucgaaaaaggaaagauuacaaaaucuaucgagcucgaugcucccaauagccacuacgaagagugcuccuguuacccugacgccggcaccgugaugugcgugugccgggauaacuggcaugggucuaaucgccccugggucagcuuuaaccaaaaucuggacuaucagauuggauacaucuguuccggcguuuucggggauaacccuagacccaaggacggaaagggcagcugcggcccggugaccguggacggggcugauggagucaaaggcuuuucuuaucgguacgggaauggaguguggauuggccgcacaaaguccaacagcucuagacggggguucgagaugaucugggacccuaauggcuggacggauaccgacuccaaauuucuuguuaagcaggauguggucgccaugacagacuggagcggauauuccggcucuuucgugcagcaccccgaacugaccgggcucgauuguaugcgcccuugcuuuuggguugagcugaucagaggacggcccagagaaaacacaaccauuuggacgagcggcuccucuaucagcuucuguggggugaauggagacacagcgaacugguccuggcccgauggcgccgagcuuccuuucaccauugacaaauga

SEQ ID NO: 200344 - RNA, 1413 nt, Artificial Sequence
  derived and/or modified sequence opt5 from neuraminidase__InfluenzaA__ACV49679
augaaccccaaucagaagaucauuaccaucggcagcauuuccaucgccauugggaucaucucucugaugcuccaaauuggaagcaucauuuccaucugggcuucucacagcauuagaacaggcucccagaacaauacggggaucugcaaccagcggauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucgcaucggaucuaaaggcgacgucuucgugauuagagagccuuuuaucuccugcagccaccuggaaugucggacguucuuucucacccagggcgcccugcuuaaugauaagcauucuaacgggacaguuaaagaccgcuccccguauagagcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacaaauucuccggacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgcgauaauuggcauggguccaacagacccugggugagcuucaaucagaaccuugacuaucagaucggauacauuugcucuggcgucuuuggggauaauccucggcccgaggacggagaaggcuccuguaacccuguuaccguggauggcgccaauggggugaaaggauucagcuauaaguacggcaacggggucuggaucggacgcacaaaaucuaauagacugcggaagggcuuugagaugauuugggaccccaacggguggacgaauaccgacuccgauuucagcgugaaacaagacguuguggcgaucacagauugguccggcuauucuggaucuuuuguccagcacccggaacucaccggccuggacugcauccgcccuuguuucuggguggagcuuguuagagggcugccccgggaaaacacaaccauuuggacguccggaucuagcaucuccuucugcggcgugaacagcgauacagccaauuggucuuggccugacggggcugagcuccccuuuaccauugauaaguga

SEQ ID NO: 200345 - RNA, 1410 nt, Artificial Sequence
  derived and/or modified sequence opt5 from neuraminidase__InfluenzaA__ACV53442
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 200346 - RNA, 1410 nt, Artificial Sequence; identical to SEQ ID NO: 200129
  derived and/or modified sequence opt5 from neuraminidase__InfluenzaA__ACV53452

SEQ ID NO: 200347 - RNA, 1410 nt, Artificial Sequence; identical to SEQ ID NO: 199752
  derived and/or modified sequence opt5 from neuraminidase__InfluenzaA__ACV53462

SEQ ID NO: 200348 - RNA, 1410 nt, Artificial Sequence; identical to SEQ ID NO: 199762
  derived and/or modified sequence opt5 from neuraminidase__InfluenzaA__ACV53472

SEQ ID NO: 200349 - RNA, 1410 nt, Artificial Sequence
  derived and/or modified sequence opt5 from neuraminidase__InfluenzaA__ACV53482
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuggggagaucacaugcgugugcagagauaacuggcacggaagcaaucggcccugggucuccuucaaccagaaucuggaauaucagauuggcuacaucuguagcgggauuuuuggagacaacccucgccccaaugauaaaaccggcucuugcgggccgguguccagcaacggagccaacggcguuaagggcuucucuuuuaaguaugggaauggaguguggaucggcagaacaaaauccauuagcucccggaacggguucgagaugaucugggacccuaauggauggaccgcuaccgauaacaauuuuucuauuaagcaagacaucgucggcaucaacgaauggagcggguacuccggcucuuucgugcagcaucccgagcuuacaggacuggacuguauucgcccuugcuucuggguugaacucaucagaggccggcccaaagagaauacgauuuggaccagcggguccagcaucucuuuuuguggagugaacuccgauacagucggcuggagcuggcccgacggggccgagcugccuuucaccauugauaaguga

SEQ ID NO: 200350 - RNA, 1410 nt, Artificial Sequence
  derived and/or modified sequence opt5 from neuraminidase__InfluenzaA__ACV53492
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaagccggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacagaaaccgacaauaacuuucuuaucaagcaagacaucgugggaauuaaugaguggagcggcuacuccgggucuuucguccagcaucccgaacugaccggccucgauuguauccgcccuugcuucuggguggagcugauuagaggacggcccaaagagaacacaaucuggacgagcggcuccagcauuucuuuuugugggguuaauuccgacaccgugggauggagcuggcccgauggcgccgaacuuccuuucacaaucgacaaguga

SEQ ID NO: 200351 - RNA, 1410 nt, Artificial Sequence
  derived and/or modified sequence opt5 from neuraminidase__InfluenzaA__ACV53502
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaagccggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuucuuaucaagcaagacaucgugggcauuaaugaauggagcggguacuccggcucuuucguccagcaucccgagcugaccggacucgauuguauccgcccuugcuucuggguggaacugauuagaggccggcccaaagagaacacaaucuggacgagcggguccagcauuucuuuuuguggaguuaauuccgacaccgugggcuggagcuggcccgauggggccgagcuuccuuucacaaucgacaaguga

SEQ ID NO: 200352 - RNA, 1410 nt, Artificial Sequence
  derived and/or modified sequence opt5 from neuraminidase__InfluenzaA__ACV53891
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaaaauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugugauccuaauggguggaccggaaccgacaacaauuuuagcaucaaacaagacaucgugggcauuaacgaaugguccggguacucuggcagcuucguccagcaucccgagcuuacaggacuggauugcauccgcccuuguuucuggguggaacucauuagaggccggcccaaggagaauacgaucuggaccuccgggagcucuauuuccuuuugcggaguuaacagcgacacagugggcuggucuuggcccgauggggcugagcugccuuucaccaucgacaaauga

SEQ ID NO: 200353 - RNA, 1410 nt, Artificial Sequence
  derived and/or modified sequence opt5 from neuraminidase__InfluenzaA__ACV53901
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucucgcagcuucguccagcaucccgagcuuacaggccuggauuguaucagaccuugcuucuggguggaacucauucggggacgccccaaagagaacacgaucuggaccuccggcagcucuauuuccuuuugugggguuaauagcgacacagugggauggucuuggcccgauggcgcugagcugccuuucaccaucgacaaguga

SEQ ID NO: 200354 - RNA, 1410 nt, Artificial Sequence; identical to SEQ ID NO: 199762
  derived and/or modified sequence opt5 from neuraminidase__InfluenzaA__ACV53911

SEQ ID NO: 200355 - RNA, 1410 nt, Artificial Sequence; identical to SEQ ID NO: 199752
  derived and/or modified sequence opt5 from neuraminidase__InfluenzaA__ACV67088

SEQ ID NO: 200356 - RNA, 1410 nt, Artificial Sequence; identical to SEQ ID NO: 199762
  derived and/or modified sequence opt5 from neuraminidase__InfluenzaA__ACV67168

SEQ ID NO: 200357 - RNA, 1410 nt, Artificial Sequence; identical to SEQ ID NO: 199752
  derived and/or modified sequence opt5 from neuraminidase__InfluenzaA__ACV67169

SEQ ID NO: 200358 - RNA, 1410 nt, Artificial Sequence; identical to SEQ ID NO: 199762
  derived and/or modified sequence opt5 from neuraminidase__InfluenzaA__ACV67171

SEQ ID NO: 200359 - RNA, 1410 nt, Artificial Sequence; identical to SEQ ID NO: 199762
  derived and/or modified sequence opt5 from neuraminidase__InfluenzaA__ACV67172

SEQ ID NO: 200360 - RNA, 1410 nt, Artificial Sequence; identical to SEQ ID NO: 199792
  derived and/or modified sequence opt5 from neuraminidase__InfluenzaA__ACV67173

SEQ ID NO: 200361 - RNA, 1410 nt, Artificial Sequence; identical to SEQ ID NO: 199752
  derived and/or modified sequence opt5 from neuraminidase__InfluenzaA__ACV67174

SEQ ID NO: 200362 - RNA, 1410 nt, Artificial Sequence
  derived and/or modified sequence opt5 from neuraminidase__InfluenzaA__ACV67175
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggguccaacggagugaagggcuucagcuuuaaguauggcaacgggguuuggauuggaagaacaaaauccaucucuagccggaauggcuucgagaugauuugggauccuaacggguggaccggaaccgacaauaacuuuuccaucaagcaagacaucgugggcauuaaugaauggucuggguacagcggcuccuucguccagcaucccgagcuuacaggacuggauuguauccgcccuugcuucuggguggaacucauuagaggccggcccaaagagaacacgaucuggaccagcgggucuuccauuagcuuuuguggaguuaauucugacacagugggcugguccuggcccgauggggccgagcugccuuucaccaucgacaaguga

SEQ ID NO: 200363 - RNA, 1410 nt, Artificial Sequence; identical to SEQ ID NO: 199762
  derived and/or modified sequence opt5 from neuraminidase__InfluenzaA__ACV67176

SEQ ID NO: 200364 - RNA, 1410 nt, Artificial Sequence; identical to SEQ ID NO: 199752
  derived and/or modified sequence opt5 from neuraminidase__InfluenzaA__ACV67177

SEQ ID NO: 200365 - RNA, 1410 nt, Artificial Sequence; identical to SEQ ID NO: 199762
  derived and/or modified sequence opt5 from neuraminidase__InfluenzaA__ACV67178

SEQ ID NO: 200366 - RNA, 1410 nt, Artificial Sequence; identical to SEQ ID NO: 199762
  derived and/or modified sequence opt5 from neuraminidase__InfluenzaA__ACV67179

SEQ ID NO: 200367 - RNA, 1410 nt, Artificial Sequence
  derived and/or modified sequence opt5 from neuraminidase__InfluenzaA__ACV67180
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagccuguggucagcgugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacgggagcaaccggccuuggguguccuucaaucagaaccuggaauaucagaucggauacauuuguagcggcaucuuuggggauaauccccgcccgaacgacaaaaccggaucuugcggcccugucuccagcaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcugagcugccguucaccaucgacaaguga

SEQ ID NO: 200368 - RNA, 1410 nt, Artificial Sequence
  derived and/or modified sequence opt5 from neuraminidase__InfluenzaA__ACV67181
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuuauuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauuaucaagagcguggagaugaaugcucccaacuaucauuacgaagagugcuccuguuacccugauucuagcgagauuacaugcgucugcagagacaauuggcacggguccaaccggcccuggguuagcuucaaucagaaccuggaauaucagaucggauacauuuguucuggcaucuuuggggauaauccucgccccaacgacaaaaccggauccugcggcccggugagcucuaauggggccaacggagugaagggcuucuccuuuaaguauggcaacggggucuggauuggaagaacaaaaagcaucuccucucggaauggcuucgagaugaucugggauccuaacggguggaccggaaccgacaauaacuuuagcauuaagcaagacaucgugggcauuaaugaaugguccggguacucuggcagcuucguucagcaucccgagcuuacaggacuggauuguauccgcccuugcuucuggguggaacucauuagaggccggcccaaagagaacacgaucuggaccuccgggagcucuaucuccuuuuguggagucaauagcgacacagugggcuggucuuggcccgauggggcugagcugccuuucaccauugacaaguga

SEQ ID NO: 200369 - RNA, 1410 nt, Artificial Sequence; identical to SEQ ID NO: 200186
  derived and/or modified sequence opt5 from neuraminidase__InfluenzaA__ACV67182

SEQ ID NO: 200370 - RNA, 1410 nt, Artificial Sequence
  derived and/or modified sequence opt5 from neuraminidase__InfluenzaA__ACV67183
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuaacgagaucacaugcgugugcagagauaauuggcacgggagcaaccggcccugggucuccuucaaucagaaccuggaauaucagauuggauacaucuguagcggcauuuuuggggacaauccucgccccaacgauaaaaccggaucuugcggcccgguguccagcaacggggccaauggaguuaagggcuucucuuuuaaguauggcaacgggguguggaucggaagaacaaaauccauuaauagccggaacggcuucgagaugaucugggacccuaauggguggaccggaaccgauaacaauuuuuccauuaagcaagacaucgucggcaucaacgaauggucuggguacagcggcuccuucgugcagcaucccgagcuuacaggacuggacuguauucgcccuugcuucuggguugaacucaucagaggccggcccaaagagaauacgauuuggaccucugggagcuccaucagcuuuuguggagugaacucugauacagucggcugguccuggcccgacggggcugagcugccuuucaccauugauaaguga

SEQ ID NO: 200371 - RNA, 1410 nt, Artificial Sequence; identical to SEQ ID NO: 199762
  derived and/or modified sequence opt5 from neuraminidase__InfluenzaA__ACV67184

SEQ ID NO: 200372 - RNA, 1410 nt, Artificial Sequence; identical to SEQ ID NO: 199752
  derived and/or modified sequence opt5 from neuraminidase__InfluenzaA__ACV67186

SEQ ID NO: 200373 - RNA, 1410 nt, Artificial Sequence; identical to SEQ ID NO: 199762
  derived and/or modified sequence opt5 from neuraminidase__InfluenzaA__ACV67187

SEQ ID NO: 200374 - RNA, 1410 nt, Artificial Sequence; identical to SEQ ID NO: 199762
  derived and/or modified sequence opt5 from neuraminidase__InfluenzaA__ACV67188

SEQ ID NO: 200375 - RNA, 1410 nt, Artificial Sequence; identical to SEQ ID NO: 199792
  derived and/or modified sequence opt5 from neuraminidase__InfluenzaA__ACV67189

SEQ ID NO: 200376 - RNA, 1410 nt, Artificial Sequence; identical to SEQ ID NO: 199792
  derived and/or modified sequence opt5 from neuraminidase__InfluenzaA__ACV67190

SEQ ID NO: 200377 - RNA, 1410 nt, Artificial Sequence; identical to SEQ ID NO: 199752
  derived and/or modified sequence opt5 from neuraminidase__InfluenzaA__ACV67191

SEQ ID NO: 200378 - RNA, 1410 nt, Artificial Sequence; identical to SEQ ID NO: 199792
  derived and/or modified sequence opt5 from neuraminidase__InfluenzaA__ACV67192

SEQ ID NO: 200379 - RNA, 1410 nt, Artificial Sequence; identical to SEQ ID NO: 199792
  derived and/or modified sequence opt5 from neuraminidase__InfluenzaA__ACV67193

SEQ ID NO: 200380 - RNA, 1410 nt, Artificial Sequence; identical to SEQ ID NO: 199762
  derived and/or modified sequence opt5 from neuraminidase__InfluenzaA__ACV67194

SEQ ID NO: 200381 - RNA, 1410 nt, Artificial Sequence; identical to SEQ ID NO: 199762
  derived and/or modified sequence opt5 from neuraminidase__InfluenzaA__ACV67195

SEQ ID NO: 200382 - RNA, 1410 nt, Artificial Sequence; identical to SEQ ID NO: 199762
  derived and/or modified sequence opt5 from neuraminidase__InfluenzaA__ACV67196

SEQ ID NO: 200383 - RNA, 1410 nt, Artificial Sequence; identical to SEQ ID NO: 199752
  derived and/or modified sequence opt5 from neuraminidase__InfluenzaA__ACV67197

SEQ ID NO: 200384 - RNA, 1410 nt, Artificial Sequence; identical to SEQ ID NO: 199752
  derived and/or modified sequence opt5 from neuraminidase__InfluenzaA__ACV67199

SEQ ID NO: 200385 - RNA, 1410 nt, Artificial Sequence; identical to SEQ ID NO: 199752
  derived and/or modified sequence opt5 from neuraminidase__InfluenzaA__ACV67200

SEQ ID NO: 200386 - RNA, 1410 nt, Artificial Sequence; identical to SEQ ID NO: 199752
  derived and/or modified sequence opt5 from neuraminidase__InfluenzaA__ACV67201

SEQ ID NO: 200387 - RNA, 1410 nt, Artificial Sequence; identical to SEQ ID NO: 199752
  derived and/or modified sequence opt5 from neuraminidase__InfluenzaA__ACV67202

SEQ ID NO: 200388 - RNA, 1410 nt, Artificial Sequence; identical to SEQ ID NO: 199762
  derived and/or modified sequence opt5 from neuraminidase__InfluenzaA__ACV67203

SEQ ID NO: 200389 - RNA, 1410 nt, Artificial Sequence; identical to SEQ ID NO: 199762
  derived and/or modified sequence opt5 from neuraminidase__InfluenzaA__ACV67204

SEQ ID NO: 200390 - RNA, 1410 nt, Artificial Sequence; identical to SEQ ID NO: 199762
  derived and/or modified sequence opt5 from neuraminidase__InfluenzaA__ACV67205

SEQ ID NO: 200391 - RNA, 1410 nt, Artificial Sequence
  derived and/or modified sequence opt5 from neuraminidase__InfluenzaA__ACV67206
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcaugguguccgucaaacuugcgggaaauucuagccugugcccuguguccggcugggcuauuuacagcaaggacaacucuguuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcaauggccaggccucuuacaaaaucuuucgcauugaaaagggcaaaaucgucaagagcguugagaugaacgcucccaauuauuacuacgaagagugcuccuguuauccugacucuagcgagaucacaugcgugugcagagauaacuggcauggguccaaucggcccugggugagcuucaaccagaaucuggaauaccagauuggauauaucuguucuggcauuuuuggggacaacccucgccccaaugauaaaaccggauccugcggcccggucagcucuaacggggccaacggagugaagggcuucuccuuuaaguacggcaaugggguuuggaucggaagaacaaaaagcauuuccucucggaacggcuucgagaugaucugggacccuaauggguggaccggaaccgauaacaauuuuagcauuaagcaagacaucgugggcaucaacgaaugguccggguauucuggcagcuucguccagcaccccgagcuuacaggacuggacuguauucgcccuugcuucuggguggaacucaucagaggccggcccaaagagaauacgauuuggaccuccgggagcucuaucuccuuuuguggaguuaacagcgauacagugggcuggucuuggcccgacggggcugagcugccuuucaccauugauaaguga

SEQ ID NO: 200392 - RNA, 1410 nt, Artificial Sequence; identical to SEQ ID NO: 199752
  derived and/or modified sequence opt5 from neuraminidase__InfluenzaA__ACV67207

SEQ ID NO: 200393 - RNA, 1410 nt, Artificial Sequence; identical to SEQ ID NO: 199762
  derived and/or modified sequence opt5 from neuraminidase__InfluenzaA__ACV67208

SEQ ID NO: 200394 - RNA, 1410 nt, Artificial Sequence; identical to SEQ ID NO: 199752
  derived and/or modified sequence opt5 from neuraminidase__InfluenzaA__ACV67210

SEQ ID NO: 200395 - RNA, 1410 nt, Artificial Sequence; identical to SEQ ID NO: 199762
  derived and/or modified sequence opt5 from neuraminidase__InfluenzaA__ACV67211

SEQ ID NO: 200396 - RNA, 1410 nt, Artificial Sequence; identical to SEQ ID NO: 199762
  derived and/or modified sequence opt5 from neuraminidase__InfluenzaA__ACV70076

SEQ ID NO: 200397 - RNA, 1410 nt, Artificial Sequence
  derived and/or modified sequence opt5 from neuraminidase__InfluenzaA__ACV70086
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuguuagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200398 - RNA, 1410 nt, Artificial Sequence
  derived and/or modified sequence opt5 from neuraminidase__InfluenzaA__ACV70096
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucaccgcugggcagagcguggucuccgugaaacuugccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugcuuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 200399 - RNA, 1410 nt, Artificial Sequence; identical to SEQ ID NO: 199762
  derived and/or modified sequence opt5 from neuraminidase__InfluenzaA__ACV70106

SEQ ID NO: 200400 - RNA, 1410 nt, Artificial Sequence; identical to SEQ ID NO: 199762
  derived and/or modified sequence opt5 from neuraminidase__InfluenzaA__ACV70116

SEQ ID NO: 200401 - RNA, 1410 nt, Artificial Sequence; identical to SEQ ID NO: 199762
  derived and/or modified sequence opt5 from neuraminidase__InfluenzaA__ACV70126

SEQ ID NO: 200402 - RNA, 1410 nt, Artificial Sequence; identical to SEQ ID NO: 199762
  derived and/or modified sequence opt5 from neuraminidase__InfluenzaA__ACV70157

SEQ ID NO: 200403 - RNA, 1410 nt, Artificial Sequence; identical to SEQ ID NO: 199752
  derived and/or modified sequence opt5 from neuraminidase__InfluenzaA__ACV70167

SEQ ID NO: 200404 - RNA, 1410 nt, Artificial Sequence; identical to SEQ ID NO: 199762
  derived and/or modified sequence opt5 from neuraminidase__InfluenzaA__ACV70177

SEQ ID NO: 200405 - RNA, 1410 nt, Artificial Sequence; identical to SEQ ID NO: 199762
  derived and/or modified sequence opt5 from neuraminidase__InfluenzaA__ACV70187

SEQ ID NO: 200406 - RNA, 1410 nt, Artificial Sequence; identical to SEQ ID NO: 199762
  derived and/or modified sequence opt5 from neuraminidase__InfluenzaA__ACV70197

SEQ ID NO: 200407 - RNA, 1410 nt, Artificial Sequence; identical to SEQ ID NO: 199762
  derived and/or modified sequence opt5 from neuraminidase__InfluenzaA__ACV70207

SEQ ID NO: 200408 - RNA, 1410 nt, Artificial Sequence
  derived and/or modified sequence opt5 from neuraminidase__InfluenzaA__ACV70217
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucucaucucgaaugccgcaccuuuuuccugacacagggcgcccuucugaaugacaagcacuccaacggcaccaucaaagauagaagccccuaucggacgcucaugucuuguccuauuggggagguucccuccccuuacaacagccgcuuugaauccguggccuggucugcuagcgccugccaugacggaaucaauuggcugaccauuggcaucuccgggcccgauaacggagcugucgccgugcugaaguauaauggcaucauuacagacaccaucaagagcuggagaaacaauauucuccggacacaagagucugagugugcgugcgugaacggguccuguuucaccgucaugacggauggaccuagcaauggccaggccucuuacaaaaucuuucgcauugaaaagggcaaaaucguuaagagcguggagaugaacgcuccgaauuaucacuacgaagagugcuccuguuaccccgacucuagcgagaucacaugcgugugcagagauaacuggcauggguccaaucggccuugggucagcuucaaccagaaucuggaauaucagauuggauacaucuguucuggcauuuuuggggacaacccccgcccuaaugauaaaaccggauccugcggccccgugagcucuaacggggccaacggaguuaagggcuucuccuuuaaguauggcaaugggguguggaucggaagaacaaaaagcauuuccucucggaacggcuucgagaugaucugggacccgaauggguggaccggaaccgauaacaauuuuagcauuaagcaagacaucgucggcaucaacgaaugguccggguacucuggcagcuucgugcagcacccugagcuuacaggacuggacuguauucgccccugcuucuggguugaacucaucagaggccggccuaaagagaauacgauuuggaccuccgggagcucuaucuccuuuuguggagugaacagcgauacagucggcuggucuuggcccgacggggcugagcugcccuucaccauugauaaguga

SEQ ID NO: 200409 - RNA, 1410 nt, Artificial Sequence; identical to SEQ ID NO: 199762
  derived and/or modified sequence opt5 from neuraminidase__InfluenzaA__ACV70227

SEQ ID NO: 200410 - RNA, 1410 nt, Artificial Sequence; identical to SEQ ID NO: 199762
  derived and/or modified sequence opt5 from neuraminidase__InfluenzaA__ACV70237

SEQ ID NO: 200411 - RNA, 1410 nt, Artificial Sequence; identical to SEQ ID NO: 199762
  derived and/or modified sequence opt5 from neuraminidase__InfluenzaA__ACV70247

SEQ ID NO: 200412 - RNA, 1410 nt, Artificial Sequence; identical to SEQ ID NO: 199762
  derived and/or modified sequence opt5 from neuraminidase__InfluenzaA__ACV70257

SEQ ID NO: 200413 - RNA, 1410 nt, Artificial Sequence; identical to SEQ ID NO: 199762
  derived and/or modified sequence opt5 from neuraminidase__InfluenzaA__ACV70267

SEQ ID NO: 200414 - RNA, 1410 nt, Artificial Sequence; identical to SEQ ID NO: 199762
  derived and/or modified sequence opt5 from neuraminidase__InfluenzaA__ACV70277

SEQ ID NO: 200415 - RNA, 1410 nt, Artificial Sequence; identical to SEQ ID NO: 199762
  derived and/or modified sequence opt5 from neuraminidase__InfluenzaA__ACV70287

SEQ ID NO: 200416 - RNA, 1410 nt, Artificial Sequence; identical to SEQ ID NO: 199762
  derived and/or modified sequence opt5 from neuraminidase__InfluenzaA__ACV70297

SEQ ID NO: 200417 - RNA, 1410 nt, Artificial Sequence; identical to SEQ ID NO: 199762
  derived and/or modified sequence opt5 from neuraminidase__InfluenzaA__ACV70307

SEQ ID NO: 200418 - RNA, 1410 nt, Artificial Sequence; identical to SEQ ID NO: 199752
  derived and/or modified sequence opt5 from neuraminidase__InfluenzaA__ACV70317

SEQ ID NO: 200419 - RNA, 1410 nt, Artificial Sequence; identical to SEQ ID NO: 199762
  derived and/or modified sequence opt5 from neuraminidase__InfluenzaA__ACV70327

SEQ ID NO: 200420 - RNA, 1410 nt, Artificial Sequence; identical to SEQ ID NO: 199762
  derived and/or modified sequence opt5 from neuraminidase__InfluenzaA__ACV70337

SEQ ID NO: 200421 - RNA, 1410 nt, Artificial Sequence; identical to SEQ ID NO: 199762
  derived and/or modified sequence opt5 from neuraminidase__InfluenzaA__ACV70347

SEQ ID NO: 200422 - RNA, 1410 nt, Artificial Sequence; identical to SEQ ID NO: 199762
  derived and/or modified sequence opt5 from neuraminidase__InfluenzaA__ACV70357

SEQ ID NO: 200423 - RNA, 1410 nt, Artificial Sequence; identical to SEQ ID NO: 199762
  derived and/or modified sequence opt5 from neuraminidase__InfluenzaA__ACV70367

SEQ ID NO: 200424 - RNA, 1410 nt, Artificial Sequence; identical to SEQ ID NO: 199762
  derived and/or modified sequence opt5 from neuraminidase__InfluenzaA__ACV70377

SEQ ID NO: 200425 - RNA, 1410 nt, Artificial Sequence; identical to SEQ ID NO: 199762
  derived and/or modified sequence opt5 from neuraminidase__InfluenzaA__ACV70387

SEQ ID NO: 200426 - RNA, 1410 nt, Artificial Sequence; identical to SEQ ID NO: 199762
  derived and/or modified sequence opt5 from neuraminidase__InfluenzaA__ACV70397

SEQ ID NO: 200427 - RNA, 1410 nt, Artificial Sequence; identical to SEQ ID NO: 199762
  derived and/or modified sequence opt5 from neuraminidase__InfluenzaA__ACV70407

SEQ ID NO: 200428 - RNA, 1410 nt, Artificial Sequence; identical to SEQ ID NO: 199752
  derived and/or modified sequence opt5 from neuraminidase__InfluenzaA__ACV70417

SEQ ID NO: 200429 - RNA, 1410 nt, Artificial Sequence; identical to SEQ ID NO: 199762
  derived and/or modified sequence opt5 from neuraminidase__InfluenzaA__ACV70427

SEQ ID NO: 200430 - RNA, 1410 nt, Artificial Sequence; identical to SEQ ID NO: 199762
  derived and/or modified sequence opt5 from neuraminidase__InfluenzaA__ACV70437

SEQ ID NO: 200431 - RNA, 1410 nt, Artificial Sequence; identical to SEQ ID NO: 199762
  derived and/or modified sequence opt5 from neuraminidase__InfluenzaA__ACV70447

SEQ ID NO: 200432 - RNA, 1410 nt, Artificial Sequence; identical to SEQ ID NO: 199762
  derived and/or modified sequence opt5 from neuraminidase__InfluenzaA__ACV70457

SEQ ID NO: 200433 - RNA, 1410 nt, Artificial Sequence; identical to SEQ ID NO: 199762
  derived and/or modified sequence opt5 from neuraminidase__InfluenzaA__ACV70467

SEQ ID NO: 200434 - RNA, 1410 nt, Artificial Sequence; identical to SEQ ID NO: 199762
  derived and/or modified sequence opt5 from neuraminidase__InfluenzaA__ACV70477

SEQ ID NO: 200435 - RNA, 1410 nt, Artificial Sequence; identical to SEQ ID NO: 199762
  derived and/or modified sequence opt5 from neuraminidase__InfluenzaA__ACV70487

SEQ ID NO: 200436 - RNA, 1410 nt, Artificial Sequence; identical to SEQ ID NO: 199762
  derived and/or modified sequence opt5 from neuraminidase__InfluenzaA__ACV70497

SEQ ID NO: 200437 - RNA, 1410 nt, Artificial Sequence; identical to SEQ ID NO: 199762
  derived and/or modified sequence opt5 from neuraminidase__InfluenzaA__ACV70507

SEQ ID NO: 200438 - RNA, 1410 nt, Artificial Sequence; identical to SEQ ID NO: 199762
  derived and/or modified sequence opt5 from neuraminidase__InfluenzaA__ACV70517

SEQ ID NO: 200439 - RNA, 1410 nt, Artificial Sequence; identical to SEQ ID NO: 199762
  derived and/or modified sequence opt5 from neuraminidase__InfluenzaA__ACV70527

SEQ ID NO: 200440 - RNA, 1410 nt, Artificial Sequence; identical to SEQ ID NO: 199762
  derived and/or modified sequence opt5 from neuraminidase__InfluenzaA__ACV70547

SEQ ID NO: 200441 - RNA, 1410 nt, Artificial Sequence; identical to SEQ ID NO: 199762
  derived and/or modified sequence opt5 from neuraminidase__InfluenzaA__ACV70557

SEQ ID NO: 200442 - RNA, 1410 nt, Artificial Sequence; identical to SEQ ID NO: 199762
  derived and/or modified sequence opt5 from neuraminidase__InfluenzaA__ACV70567

SEQ ID NO: 200443 - RNA, 1410 nt, Artificial Sequence; identical to SEQ ID NO: 199762
  derived and/or modified sequence opt5 from neuraminidase__InfluenzaA__ACV70577

SEQ ID NO: 200444 - RNA, 1410 nt, Artificial Sequence; identical to SEQ ID NO: 199762
  derived and/or modified sequence opt5 from neuraminidase__InfluenzaA__ACV70587

SEQ ID NO: 200445 - RNA, 1410 nt, Artificial Sequence; identical to SEQ ID NO: 199752
  derived and/or modified sequence opt5 from neuraminidase__InfluenzaA__ACV70597

SEQ ID NO: 200446 - RNA, 1410 nt, Artificial Sequence; identical to SEQ ID NO: 199762
  derived and/or modified sequence opt5 from neuraminidase__InfluenzaA__ACV70607

SEQ ID NO: 200447 - RNA, 1410 nt, Artificial Sequence; identical to SEQ ID NO: 200345
  derived and/or modified sequence opt5 from neuraminidase__InfluenzaA__ACV70617

SEQ ID NO: 200448 - RNA, 1410 nt, Artificial Sequence; identical to SEQ ID NO: 199762
  derived and/or modified sequence opt5 from neuraminidase__InfluenzaA__ACV70647

SEQ ID NO: 200449 - RNA, 1410 nt, Artificial Sequence; identical to SEQ ID NO: 199762
  derived and/or modified sequence opt5 from neuraminidase__InfluenzaA__ACV70657

SEQ ID NO: 200450 - RNA, 1410 nt, Artificial Sequence; identical to SEQ ID NO: 199762
  derived and/or modified sequence opt5 from neuraminidase__InfluenzaA__ACV70667

SEQ ID NO: 200451 - RNA, 1410 nt, Artificial Sequence; identical to SEQ ID NO: 199762
  derived and/or modified sequence opt5 from neuraminidase__InfluenzaA__ACV70677

SEQ ID NO: 200452 - RNA, 1410 nt, Artificial Sequence; identical to SEQ ID NO: 199762
  derived and/or modified sequence opt5 from neuraminidase__InfluenzaA__ACV70687

SEQ ID NO: 200453 - RNA, 1410 nt, Artificial Sequence; identical to SEQ ID NO: 199762
  derived and/or modified sequence opt5 from neuraminidase__InfluenzaA__ACV70697

SEQ ID NO: 200454 - RNA, 1410 nt, Artificial Sequence; identical to SEQ ID NO: 199762
  derived and/or modified sequence opt5 from neuraminidase__InfluenzaA__ACV70707

SEQ ID NO: 200455 - RNA, 1410 nt, Artificial Sequence; identical to SEQ ID NO: 199762
  derived and/or modified sequence opt5 from neuraminidase__InfluenzaA__ACV70717

SEQ ID NO: 200456 - RNA, 1410 nt, Artificial Sequence; identical to SEQ ID NO: 199762
  derived and/or modified sequence opt5 from neuraminidase__InfluenzaA__ACV70727

SEQ ID NO: 200457 - RNA, 1410 nt, Artificial Sequence; identical to SEQ ID NO: 199762
  derived and/or modified sequence opt5 from neuraminidase__InfluenzaA__ACV70737

SEQ ID NO: 200458 - RNA, 1410 nt, Artificial Sequence; identical to SEQ ID NO: 199762
  derived and/or modified sequence opt5 from neuraminidase__InfluenzaA__ACV70757

SEQ ID NO: 200459 - RNA, 1410 nt, Artificial Sequence; identical to SEQ ID NO: 199762
  derived and/or modified sequence opt5 from neuraminidase__InfluenzaA__ACV70767

SEQ ID NO: 200460 - RNA, 1410 nt, Artificial Sequence; identical to SEQ ID NO: 199762
  derived and/or modified sequence opt5 from neuraminidase__InfluenzaA__ACV70777

SEQ ID NO: 200461 - RNA, 1410 nt, Artificial Sequence; identical to SEQ ID NO: 199762
  derived and/or modified sequence opt5 from neuraminidase__InfluenzaA__ACV70787

SEQ ID NO: 200462 - RNA, 1410 nt, Artificial Sequence; identical to SEQ ID NO: 199762
  derived and/or modified sequence opt5 from neuraminidase__InfluenzaA__ACV70797

SEQ ID NO: 200463 - RNA, 1410 nt, Artificial Sequence; identical to SEQ ID NO: 199762
  derived and/or modified sequence opt5 from neuraminidase__InfluenzaA__ACV70807

SEQ ID NO: 200464 - RNA, 1410 nt, Artificial Sequence; identical to SEQ ID NO: 199762
  derived and/or modified sequence opt5 from neuraminidase__InfluenzaA__ACV70817

SEQ ID NO: 200465 - RNA, 1410 nt, Artificial Sequence; identical to SEQ ID NO: 199752
  derived and/or modified sequence opt5 from neuraminidase__InfluenzaA__ACV70827

SEQ ID NO: 200466 - RNA, 1410 nt, Artificial Sequence; identical to SEQ ID NO: 199762
  derived and/or modified sequence opt5 from neuraminidase__InfluenzaA__ACV70837

SEQ ID NO: 200467 - RNA, 1410 nt, Artificial Sequence
  derived and/or modified sequence opt5 from neuraminidase__InfluenzaA__ACV70847
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaugagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 200468 - RNA, 1410 nt, Artificial Sequence; identical to SEQ ID NO: 199762
  derived and/or modified sequence opt5 from neuraminidase__InfluenzaA__ACV70867

SEQ ID NO: 200469 - RNA, 1410 nt, Artificial Sequence; identical to SEQ ID NO: 199762
  derived and/or modified sequence opt5 from neuraminidase__InfluenzaA__ACV70877

SEQ ID NO: 200470 - RNA, 1410 nt, Artificial Sequence
  derived and/or modified sequence opt5 from neuraminidase__InfluenzaA__ACV70887
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcaugguguccgucaaacuugcgggaaauucuagccugugcccuguguccggcugggcuauuuacagcaaggacaacucuguuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcaauggccaggccucuuacaaaaucuuucgcauugaaaagggcaaaaucgucaagagcguugagaugaacgcucccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccggucagcucuaacggggccaacggagugaagggcuucuccuuuaaguauggcaaugggguuuggaucggaagaacaaaaagcauuuccucucggaacggcuucgagaugaucugggacccuaauggguggaccggaaccgauaacaauuuuagcauuaagcaagacaucgugggcaucaacgaaugguccggguacucuggcagcuucguccagcaucccgagcuuacaggacuggacuguauucgcccuugcuucuggguggaacucaucagaggccggcccaaagagaauacgauuuggaccuccgggagcucuaucuccuuuuguggaguuaacagcgauacagugggcuggucuuggcccgacggggcugagcugccuuucaccauugauaaguga

SEQ ID NO: 200471 - RNA, 1410 nt, Artificial Sequence; identical to SEQ ID NO: 199762
  derived and/or modified sequence opt5 from neuraminidase__InfluenzaA__ACV70897

SEQ ID NO: 200472 - RNA, 1410 nt, Artificial Sequence; identical to SEQ ID NO: 199762
  derived and/or modified sequence opt5 from neuraminidase__InfluenzaA__ACV70907

SEQ ID NO: 200473 - RNA, 1410 nt, Artificial Sequence; identical to SEQ ID NO: 199762
  derived and/or modified sequence opt5 from neuraminidase__InfluenzaA__ACV70917

SEQ ID NO: 200474 - RNA, 1410 nt, Artificial Sequence; identical to SEQ ID NO: 199752
  derived and/or modified sequence opt5 from neuraminidase__InfluenzaA__ACV70927

SEQ ID NO: 200475 - RNA, 1410 nt, Artificial Sequence; identical to SEQ ID NO: 199762
  derived and/or modified sequence opt5 from neuraminidase__InfluenzaA__ACV70937

SEQ ID NO: 200476 - RNA, 1410 nt, Artificial Sequence; identical to SEQ ID NO: 199762
  derived and/or modified sequence opt5 from neuraminidase__InfluenzaA__ACV70947

SEQ ID NO: 200477 - RNA, 1410 nt, Artificial Sequence; identical to SEQ ID NO: 199762
  derived and/or modified sequence opt5 from neuraminidase__InfluenzaA__ACV70957

SEQ ID NO: 200478 - RNA, 1410 nt, Artificial Sequence; identical to SEQ ID NO: 199762
  derived and/or modified sequence opt5 from neuraminidase__InfluenzaA__ACV70967

SEQ ID NO: 200479 - RNA, 1410 nt, Artificial Sequence; identical to SEQ ID NO: 199762
  derived and/or modified sequence opt5 from neuraminidase__InfluenzaA__ACV70977

SEQ ID NO: 200480 - RNA, 1410 nt, Artificial Sequence; identical to SEQ ID NO: 199762
  derived and/or modified sequence opt5 from neuraminidase__InfluenzaA__ACV70987

SEQ ID NO: 200481 - RNA, 1410 nt, Artificial Sequence; identical to SEQ ID NO: 199762
  derived and/or modified sequence opt5 from neuraminidase__InfluenzaA__ACV71007

SEQ ID NO: 200482 - RNA, 1410 nt, Artificial Sequence; identical to SEQ ID NO: 199623
  derived and/or modified sequence opt5 from neuraminidase__InfluenzaA__ACV82218

SEQ ID NO: 200483 - RNA, 1410 nt, Artificial Sequence; identical to SEQ ID NO: 199623
  derived and/or modified sequence opt5 from neuraminidase__InfluenzaA__ACV82219

SEQ ID NO: 200484 - RNA, 1410 nt, Artificial Sequence
  derived and/or modified sequence opt5 from neuraminidase__InfluenzaA__ACV82220
augaaccccaaucagaagaucauuaccaucggcagcgugucccugacaauuucuacgaucugcuucuuuaugcaacucgccauucugaucaccacagucacccuucacuucaaacaguacgaguuuaacagcccuccgaauaaccagguuaugcugugugaacccacaaucauugagagaaauaucaccgaaauuguguaucucacaaacaccacgaucgagaaggaaauuugcccuaaacuggcugaguaccggaauugguccaagccccagugugacaucaccggguucgccccuuuuucuaaagauaacagcauucgccuuuccgcgggaggcgacaucugggugacaagagagcccuaugucucuugcgauccugacaaguguuaccaauucgcucuggggcagggaaccacacucaauaacgugcauagcaauaacaccguucgggaucgcacgccguauagaacacugcugaugaaugaacucggcgugcccuuucaccuggggaccaagcaggucugcaucgccugguccagcuacucuugucaugacggaaaagccuggcuucacgugugcauuacaggcgaugacaagaacgcuaccgccuccuucaucuauaauggccggcugguugauagcguggucucuugguccaaagagauucuccgcacccaggaaagcgagugugugugcaucaacgggacauguacgguggucaugaccgacggaucugcuuccggcaaggccgauacaaaaauucuguuuaucgaggaagggaagaucguucauaccagcacacuuuccggaucugcgcaacacguggaggaaugcagcugcuacccuagauaccccggcgugcggugugucugccgcgacaacuggaagggguccaauagaccuauuguggauaucaacauuaaagaccacagcaucguuucuuccuauguguguagcggacuggucggcgacacgccccggaagaaugauucuagcuccucuagccauugccucgacccgaacaaugaggaaggcgggcacggagugaaaggcugggccuucgaugacgggaacgauguuuggaugggacgcaccauuuccgaaaagagcagacugggcuacgagacauuuaaagugaucgagggguggucuaauccuaaguccaaacugcagaucaaccggcaggucauuguggaccgcggaaauagaagcggcuauucuggcaucuucuccgucgagggaaagagcuguauuaaccggugcuuuuacguggaacucaucagagggcgcaaggagaaaaccgaaguucuguggaccuccaauucuauuguggucuucuguggcacaagcgggaccuauggaacaggcuccuggcccgauggggcugacaucaaccuuaugccuauuuga

SEQ ID NO: 200485 - RNA, 1413 nt, Artificial Sequence
  derived and/or modified sequence opt5 from neuraminidase__InfluenzaA__ACV82221
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaaacaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuaccauugauaaguga

SEQ ID NO: 200486 - RNA, 1410 nt, Artificial Sequence; identical to SEQ ID NO: 199762
  derived and/or modified sequence opt5 from neuraminidase__InfluenzaA__ACV88402

SEQ ID NO: 200487 - RNA, 1410 nt, Artificial Sequence; identical to SEQ ID NO: 199762
  derived and/or modified sequence opt5 from neuraminidase__InfluenzaA__ACV88412

SEQ ID NO: 200488 - RNA, 1410 nt, Artificial Sequence; identical to SEQ ID NO: 199752
  derived and/or modified sequence opt5 from neuraminidase__InfluenzaA__ACV88422

SEQ ID NO: 200489 - RNA, 1365 nt, Artificial Sequence
  derived and/or modified sequence opt5 from neuraminidase__InfluenzaA__ACV89505
augaaccccaaucagaagaucauuaccaucggcagcauuugccugguggucgggcucaucucccugauucuucaaaucggaaacaucauuucuaucuggauuagccacuccauccagacaggcucucagaaucauacggggauuuguaaccagaauaucauuaccuacaaaaacagcacauggguuaaggacaccacauccgugauccugaccggaaauucuagccucugcccuaucagaggcugggccauuuauuccaaagauaacagcauccggauugggucuaagggagacguguucgucauccgcgagccguuuauuuccuguagccaccuggaaugcagaacauucuuucuuacccaaggcgcucugcucaaugauaaacauucuuccggcacggugaaggaccggagccccuaccgcgcccugaugucuuguccuguuggggaggcgcccuccccuuauaacagcagauucgaauccguggcuuggucugccagcgccugccacgauggaaugggcuggcugaccaucgggaucuccggacccgacaauggcgcugucgccgugcucaaguacaacgggauuaucacagagaccauuaaaagcuggcggaagaaaauccugcgcacacaggaaucugagugugcuugcguuaauggauccuguuuuaccauuaugacggauggcccuagcgacggccuugccucuuauaagaucuucaaaaucgagaaggggaaggugacaaaaagcauugaacugaacgcgcccaauucccauuacgaggaaugcucuuguuauccggauaccggaaaggucaugugcgugugcagagacaacuggcacggcagcaaccggccuuggguguccuuugaucagaaucucgacuaccagaucggguacauuuguagcggagucuucggcgauaacccccgcccugaggacgggacaggaucuugcggccccguuuauguggacggcgccaauggggugaaaggauuuuccuacagauauggcaacggggucuggaucggacggaccaagagccacucuucccgccauggcuucgagaugauuugggauccgaauggguggaccgaaacagacagcaaauuuuccgugagacaagauguuguggcuaugacggacuggucuggcuacagcggauccuucguccagcacccugagcugaccggccuugauuguaugcggcccugcuuuuggguggaacugauccgcgggagaccuaaggagggaacaauuuggaccucugccagcuccaucagcuucuguggcguuaacucugacacaguggauugguccuggcccgacggggcugaacuccccuucagcaucgauaaauga

SEQ ID NO: 200490 - RNA, 1410 nt, Artificial Sequence; identical to SEQ ID NO: 199762
  derived and/or modified sequence opt5 from neuraminidase__InfluenzaA__ACV91673

SEQ ID NO: 200491 - RNA, 1410 nt, Artificial Sequence; identical to SEQ ID NO: 199762
  derived and/or modified sequence opt5 from neuraminidase__InfluenzaA__ACV91681

SEQ ID NO: 200492 - RNA, 1410 nt, Artificial Sequence
  derived and/or modified sequence opt5 from neuraminidase__InfluenzaA__ACX31593
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguucuucugugugaacccgcuauuaucgagagaaauauuacagaaaucguguaucucaccaacacaaccauugagaaggaaaucugcccuaaacuggccgaguaccggaauugguccaagccccagugugacauuacgggguucgcgccuuuuucuaaagauaacagcauccgccuuuccgcuggaggcgacaucugggugaccagagagcccuaugucucuugcgauccugacaaguguuaccaauucgcccuggggcagggaacaacccucaauaacgugcauagcaauaacacaguucgggaucgcaccccguauagaacgcugcugaugaaugaacucggcgugcccuuucaccuggggacaaagcaggucugcauugccugguccucuagcuccugucaugacggaaaggcuuggcuucacgugugcaucaccggcgaugacaaaaacgccacagcuagcuucauuuacaauggccggcugguugauucuguggucuccuggagcaaagagauccuccgcacccaggaaucugagugugugugcauuaacgggaccuguacaguggucaugacggacggauccgccagcggcaaggcggauaccaaaauccuguuuaucgaggaagggaagauuguucauacauccacccuuucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuggucggcgacacaccccggaagaaugauagcuccucuagcucccauugccucgacccgaacaaugaggaaggcgggcacggagugaaaggcugggcuuucgaugacgggaacgauguuuggaugggacgcaccaucagcgagaagucuagacugggcuaugagacguuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacucauuagaggacgcaaggaggaaacagagguucuguggaccucuaauagcaucguggucuucuguggcaccuccgggacauacggaaccggcucuuggcccgauggggccgacauuaaccuuaugccuaucuga

SEQ ID NO: 200493 - RNA, 1410 nt, Artificial Sequence; identical to SEQ ID NO: 199762
  derived and/or modified sequence opt5 from neuraminidase__InfluenzaA__ACX31901

SEQ ID NO: 200494 - RNA, 1410 nt, Artificial Sequence; identical to SEQ ID NO: 199762
  derived and/or modified sequence opt5 from neuraminidase__InfluenzaA__ACX31902

SEQ ID NO: 200495 - RNA, 1410 nt, Artificial Sequence; identical to SEQ ID NO: 199762
  derived and/or modified sequence opt5 from neuraminidase__InfluenzaA__ACX31905

SEQ ID NO: 200496 - RNA, 1410 nt, Artificial Sequence; identical to SEQ ID NO: 199762
  derived and/or modified sequence opt5 from neuraminidase__InfluenzaA__ACX31906

SEQ ID NO: 200497 - RNA, 1410 nt, Artificial Sequence; identical to SEQ ID NO: 199762
  derived and/or modified sequence opt5 from neuraminidase__InfluenzaA__ACX31907

SEQ ID NO: 200498 - RNA, 1410 nt, Artificial Sequence; identical to SEQ ID NO: 199762
  derived and/or modified sequence opt5 from neuraminidase__InfluenzaA__ACX31908

SEQ ID NO: 200499 - RNA, 1410 nt, Artificial Sequence; identical to SEQ ID NO: 199917
  derived and/or modified sequence opt5 from neuraminidase__InfluenzaA__ACX31909

SEQ ID NO: 200500 - RNA, 1410 nt, Artificial Sequence; identical to SEQ ID NO: 199762
  derived and/or modified sequence opt5 from neuraminidase__InfluenzaA__ACX31911

SEQ ID NO: 200501 - RNA, 1410 nt, Artificial Sequence; identical to SEQ ID NO: 199762
  derived and/or modified sequence opt5 from neuraminidase__InfluenzaA__ACX31912

SEQ ID NO: 200502 - RNA, 1410 nt, Artificial Sequence; identical to SEQ ID NO: 199762
  derived and/or modified sequence opt5 from neuraminidase__InfluenzaA__ACX31913

SEQ ID NO: 200503 - RNA, 1410 nt, Artificial Sequence; identical to SEQ ID NO: 199762
  derived and/or modified sequence opt5 from neuraminidase__InfluenzaA__ACX31914

SEQ ID NO: 200504 - RNA, 1410 nt, Artificial Sequence; identical to SEQ ID NO: 199762
  derived and/or modified sequence opt5 from neuraminidase__InfluenzaA__ACX31915

SEQ ID NO: 200505 - RNA, 1410 nt, Artificial Sequence; identical to SEQ ID NO: 199762
  derived and/or modified sequence opt5 from neuraminidase__InfluenzaA__ACX31916

SEQ ID NO: 200506 - RNA, 1410 nt, Artificial Sequence
  derived and/or modified sequence opt5 from neuraminidase__InfluenzaA__ACX31917
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuacggauagaagcccuuaucggacccucaugucuugucccaucggggaggugccuucccccuacaacagccgcuuugaauccguugccuggucugcuagcgccugccacgacggaauuaauuggcugacaaucggcaucuccgggccugauaacggagcuguggccguccugaaauauaauggcauuaucaccgacacaauuaagagcuggagaaacaauauccuccggacccaagagucugagugugcgugcgugaacggguccuguuucacggugaugacagauggaccgagcgacggccaggccucuuacaagauuuuucgcaucgaaaaaggcaagaucgucaaaagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaagacaggauccugcggcccggucagcucuaauggggccaacggagugaaaggcuucuccuuuaaguauggcaacgggguuuggauuggaagaaccaagagcaucuccucucggaauggcuucgagaugauuugggauccuaacggguggaccggaacagacaauaacuuuagcaucaaacaagacaucgugggcauuaaugaaugguccggguacucuggcagcuucguccagcaucccgagcuuacgggacuggauuguauccgcccuugcuucuggguggaacucauuagaggccggcccaaggagaacaccaucuggacauccgggagcucuauuuccuuuuguggaguuaauagcgacaccgugggcuggucuuggcccgauggggcugagcugccuuucacaaucgacaaauga

SEQ ID NO: 200507 - RNA, 1410 nt, Artificial Sequence; identical to SEQ ID NO: 199762
  derived and/or modified sequence opt5 from neuraminidase__InfluenzaA__ACX31918

SEQ ID NO: 200508 - RNA, 1410 nt, Artificial Sequence; identical to SEQ ID NO: 199762
  derived and/or modified sequence opt5 from neuraminidase__InfluenzaA__ACX31919

SEQ ID NO: 200509 - RNA, 1410 nt, Artificial Sequence; identical to SEQ ID NO: 199762
  derived and/or modified sequence opt5 from neuraminidase__InfluenzaA__ACX31920

SEQ ID NO: 200510 - RNA, 1410 nt, Artificial Sequence; identical to SEQ ID NO: 200116
  derived and/or modified sequence opt5 from neuraminidase__InfluenzaA__ACX31922

SEQ ID NO: 200511 - RNA, 1410 nt, Artificial Sequence; identical to SEQ ID NO: 199762
  derived and/or modified sequence opt5 from neuraminidase__InfluenzaA__ACX31923

SEQ ID NO: 200512 - RNA, 1410 nt, Artificial Sequence; identical to SEQ ID NO: 199752
  derived and/or modified sequence opt5 from neuraminidase__InfluenzaA__ACX31924

SEQ ID NO: 200513 - RNA, 1410 nt, Artificial Sequence
  derived and/or modified sequence opt5 from neuraminidase__InfluenzaA__ACX31925
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucacccugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcuuccuuucaucaucgacaaguga

SEQ ID NO: 200514 - RNA, 1410 nt, Artificial Sequence; identical to SEQ ID NO: 199762
  derived and/or modified sequence opt5 from neuraminidase__InfluenzaA__ACX31926

SEQ ID NO: 200515 - RNA, 1410 nt, Artificial Sequence; identical to SEQ ID NO: 199762
  derived and/or modified sequence opt5 from neuraminidase__InfluenzaA__ACX31927

SEQ ID NO: 200516 - RNA, 1410 nt, Artificial Sequence
  derived and/or modified sequence opt5 from neuraminidase__InfluenzaA__ACX31928
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggagaacggagugaagggcuucuccuuuaaguauggcaacgggguuuggauuggaagaacaaaaagcaucuccucucggaauggcuucgaaaugauuugggauccuaacggguggaccggaaccgacaauaacuuuagcaucaagcaagacaucgugggcauuaaugagugguccggguacucuggcagcuucguccagcaucccgaacuuacaggacuggauuguauccgcccuugcuucuggguggagcucauuagaggccggcccaaagagaacacgaucuggaccuccgggagcucuauuuccuuuuguggaguuaauggcgacacagugggguggagcuggcccgauggagccgaacugccuuucaccaucgacaaguga

SEQ ID NO: 200517 - RNA, 1410 nt, Artificial Sequence; identical to SEQ ID NO: 199792
  derived and/or modified sequence opt5 from neuraminidase__InfluenzaA__ACX31929

SEQ ID NO: 200518 - RNA, 1410 nt, Artificial Sequence; identical to SEQ ID NO: 200116
  derived and/or modified sequence opt5 from neuraminidase__InfluenzaA__ACX31930

SEQ ID NO: 200519 - RNA, 1410 nt, Artificial Sequence; identical to SEQ ID NO: 199762
  derived and/or modified sequence opt5 from neuraminidase__InfluenzaA__ACX31931

SEQ ID NO: 200520 - RNA, 1410 nt, Artificial Sequence; identical to SEQ ID NO: 199762
  derived and/or modified sequence opt5 from neuraminidase__InfluenzaA__ACX31932

SEQ ID NO: 200521 - RNA, 1410 nt, Artificial Sequence; identical to SEQ ID NO: 199762
  derived and/or modified sequence opt5 from neuraminidase__InfluenzaA__ACX35250

SEQ ID NO: 200522 - RNA, 1410 nt, Artificial Sequence; identical to SEQ ID NO: 199762
  derived and/or modified sequence opt5 from neuraminidase__InfluenzaA__ACX35260

SEQ ID NO: 200523 - RNA, 1410 nt, Artificial Sequence; identical to SEQ ID NO: 199762
  derived and/or modified sequence opt5 from neuraminidase__InfluenzaA__ACX35270

SEQ ID NO: 200524 - RNA, 1410 nt, Artificial Sequence
  derived and/or modified sequence opt5 from neuraminidase__InfluenzaA__ACX35280
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugauaugaaugcucccaacuaucauuacgaggaaugcuccuguuacccugacucuagcgagauuacaugcgugugcagagauaauuggcacggguccaaccggcccugggugagcuucaaucagaaccuggaguaucagaucggauacauuuguucuggcaucuuuggggacaauccucgccccaacgauaaaaccggauccugcggcccggucagcucuaauggggccaacggagugaagggcuucuccuuuaaguauggcaacgggguuuggauuggaagaacaaaaagcaucuccucucggaauggcuucgaaaugauuugggacccuaacggguggaccggaaccgacaauaacuuuagcaucaagcaagauaucgugggcauuaaugagugguccggguacucuggcagcuucguccagcaucccgaacuuacaggacuggacuguauccgcccuugcuucuggguggagcucauuagaggccggcccaaagaaaacacgaucuggaccuccgggagcucuauuuccuuuuguggaguuaauagcgauacagugggcuggucuuggcccgacggggcugagcugccuuucaccaucgauaaguga

SEQ ID NO: 200525 - RNA, 1410 nt, Artificial Sequence; identical to SEQ ID NO: 199762
  derived and/or modified sequence opt5 from neuraminidase__InfluenzaA__ACX35290

SEQ ID NO: 200526 - RNA, 1410 nt, Artificial Sequence; identical to SEQ ID NO: 199762
  derived and/or modified sequence opt5 from neuraminidase__InfluenzaA__ACX35300

SEQ ID NO: 200527 - RNA, 1410 nt, Artificial Sequence
  derived and/or modified sequence opt5 from neuraminidase__InfluenzaA__ACX35310
augaaccccaaucagaagaucauuaccaucggcagcgugugcaugacaauugggauggccaaccugauccuccaaauuggaaauaucaucuccauuuggaucucucacagcauucagcugggcaaccagaaucagaucgggacguguaaccaauccgucauuaccuacgagaauaacacauggguuaaucagaccuaugugaacaucucuaauacaaacuucgcugccggacagagcguggucuccgugaaacuugcgggcaauucuagccugugcccuguuuccgggugggcuauuuacagcaaggacaacucuaucagaaucggauccaaaggcgauguguuugucauucgggaaccguucaucagcuguucuccccucgagugccgcaccuuuuuccugacacagggcgcccuucugaaugacaagcauuccaacgggaccauuaaagauagaagcccuuaucggacgcucaugucuugucccaucggagaagugccuucccccuacaacagccgcuuugaguccguugccuggucugcuagcgccugccacgacggcauuaauuggcugaccaucgggaucuccggaccugauaacggcgcuguggccguccugaaguauaaugggauuaucacagacaccauuaagagcuggagaaacaauauccuccggacacaagaaucugagugugcgugcgugaacggauccuguuucaccgugaugacggauggcccgagcgacggccaggccucuuacaaaauuuuucgcaucgagaaggggaaaaucgucaagagcguugaaaugaaugcucccaacuaucauuacgaggaaugcuccuguuacccugauucuagcgagauuacaugcgugugcagagacaauuggcacggauccaaccggcccugggugagcuucaaucagaaccuggaguaucagaucggcuacauuuguucugggaucuuuggagauaauccucgccccaacgacaaaaccggcuccugcgggccggucagcucuaauggagccaacggcgugaagggcuucuccuuuaaguaugggaacggaguuuggauuggcagaacaaaaagcaucuccucucggaauggguucgaaaugauuugggauccuaacggauggaccggcaccgacaauaacuuuagcaucaagcaagacaucguggggauuaaugagugguccggcuacucuggcagcuucguccagcaucccgaacuuacaggacuggauuguauccgcccuugcuucuggguggagcucauuagagggcggcccaaagaaaacacgaucuggaccuccggaagcucuauuuccuuuuguggcguuaauagcgacacagugggguggucuuggcccgauggagcugagcugccuuucaccaucgacaaguga

SEQ ID NO: 200528 - RNA, 1410 nt, Artificial Sequence; identical to SEQ ID NO: 199762
  derived and/or modified sequence opt5 from neuraminidase__InfluenzaA__ACX35320

SEQ ID NO: 200529 - RNA, 1410 nt, Artificial Sequence
  derived and/or modified sequence opt5 from neuraminidase__InfluenzaA__ACX35330
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccaucggcauuuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccaucgacaaguga

SEQ ID NO: 200530 - RNA, 1410 nt, Artificial Sequence; identical to SEQ ID NO: 199762
  derived and/or modified sequence opt5 from neuraminidase__InfluenzaA__ACX48479

SEQ ID NO: 200531 - RNA, 1410 nt, Artificial Sequence; identical to SEQ ID NO: 199762
  derived and/or modified sequence opt5 from neuraminidase__InfluenzaA__ACX48481

SEQ ID NO: 200532 - RNA, 1410 nt, Artificial Sequence; identical to SEQ ID NO: 199762
  derived and/or modified sequence opt5 from neuraminidase__InfluenzaA__ACX55836

SEQ ID NO: 200533 - RNA, 1410 nt, Artificial Sequence
  derived and/or modified sequence opt5 from neuraminidase__InfluenzaA__ACX56269
augaaccccaagcagaaaaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 200534 - RNA, 1410 nt, Artificial Sequence
  derived and/or modified sequence opt5 from neuraminidase__InfluenzaA__ACX56270
augaaccccaagcagaaaaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacucuguguccuggagcuggcccgauggcgcugagcugccuuucacaaucgacaaauga

SEQ ID NO: 200535 - RNA, 1410 nt, Artificial Sequence
  derived and/or modified sequence opt5 from neuraminidase__InfluenzaA__ACX56271
augaaccccaagcagaaaaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaaucuugcugccgggcagagcgugggauccgucaagcuggcgggcaacucuagccucugcccuguguccgggugggcuauuuacagcaaagacaauucuaucagaaucggauccaagggcgauguuuucgugauucgggagccguuuaucagcuguucuccccuggaaugccgcaccuucuuucuuacacagggcgcccugcucaacgacaaacauuccaaugggaccauuaaggauagaagcccuuaucggacgcugaugucuugucccaucggagaggucccuucccccuacaacagccgcuucgaauccguggccuggucugcuagcgccugccacgacggcauuaacuggcugaccaucgggaucuccggaccugauaauggcgcuguugccgugcucaaguauaacgggauuaucacagacaccauuaaaagcuggagaaauaacauccugcggacacaagagucugagugugcgugcgucaauggauccuguuuuaccgugaugacggauggcccgagcgacggccaggccucuuacaagauuuuccgcaucgaaaaagggaagaucgugaaaagcgucgagaugaacgcucccaauuaucauuacgaagagugcuccuguuacccugauucuagcgagauuacaugcguuugcagagacaacuggcacggauccaaucggcccugggugagcuuuaaccagaaucuugaauaucagaucggcuacauuuguucugggaucuucggagauaacccucgccccaaugacaagaccggcuccugcgggccggugagcucuaacggagccaauggcgucaagggcuuuuccuucaaauaugggaacggaguguggauuggcagaacaaagagcaucuccucucggaacggguuugagaugauuugggauccuaauggauggaccggcaccgacaacaauuucagcaucaaacaagacaucguugggauuaacgaaugguccggcuacucuggcagcuuugugcagcaucccgagcugacaggacucgauuguauccgcccuugcuucugggucgaacugauuagagggcggcccaaggagaauacgaucuggaccuccggaagcucuauuuccuucuguggcgugaacagcgacacaguuggguggucuuggcccgauggagcugagcuuccuuuuaccaucgacaaauga

SEQ ID NO: 200536 - RNA, 1410 nt, Artificial Sequence; identical to SEQ ID NO: 199762
  derived and/or modified sequence opt5 from neuraminidase__InfluenzaA__ACX83579

SEQ ID NO: 200537 - RNA, 1410 nt, Artificial Sequence; identical to SEQ ID NO: 199762
  derived and/or modified sequence opt5 from neuraminidase__InfluenzaA__ACX85425

SEQ ID NO: 200538 - RNA, 1410 nt, Artificial Sequence; identical to SEQ ID NO: 199762
  derived and/or modified sequence opt5 from neuraminidase__InfluenzaA__ACX85426

SEQ ID NO: 200539 - RNA, 1410 nt, Artificial Sequence
  derived and/or modified sequence opt5 from neuraminidase__InfluenzaA__ACY02998
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcaauggccaggccucuuacaaaauuuuucgcaucgaaaagggcaaaaucgucaagagcguugagaugaacgcucccaauuaucauuacgaagagugcuccuguuacccugacucuggggagauuacaugcgugugcagagauaacuggcacggaagcaaucggcccuggguguccuucaaccagaaucuggaauaucagaucggcuacauuuguagcgggaucuuuggagacaacccucgccccaaugauaaaaccggcucuugcgggccggucuccagcaacggagccaacggcgugaagggcuucucuuuuaaguaugggaauggaguuuggauuggcagaacaaaauccaucagcucccggaacggguucgagaugauuugggacccuaauggauggaccggcaccgauaacaauuuuucuaucaagcaagacaucguggggauuaacgaauggagcggcuacuccggaucuuucguccagcaucccgagcuuacaggccuggacuguauccgcccuugcuucuggguggaacucauuagagggcggcccaaagagaauacgaucuggaccagcggauccagcauuucuuuuuguggcguuaacuccgauacagugggguggagcuggcccgacggagcugagcugccuuucaccaucgauaaguga

SEQ ID NO: 200540 - RNA, 1410 nt, Artificial Sequence; identical to SEQ ID NO: 199762
  derived and/or modified sequence opt5 from neuraminidase__InfluenzaA__ACY03005

SEQ ID NO: 200541 - RNA, 1410 nt, Artificial Sequence; identical to SEQ ID NO: 199762
  derived and/or modified sequence opt5 from neuraminidase__InfluenzaA__ACY03008

SEQ ID NO: 200542 - RNA, 1410 nt, Artificial Sequence; identical to SEQ ID NO: 199762
  derived and/or modified sequence opt5 from neuraminidase__InfluenzaA__ACY03011

SEQ ID NO: 200543 - RNA, 1410 nt, Artificial Sequence; identical to SEQ ID NO: 199762
  derived and/or modified sequence opt5 from neuraminidase__InfluenzaA__ACY03012

SEQ ID NO: 200544 - RNA, 1410 nt, Artificial Sequence; identical to SEQ ID NO: 199762
  derived and/or modified sequence opt5 from neuraminidase__InfluenzaA__ACY03016

SEQ ID NO: 200545 - RNA, 1410 nt, Artificial Sequence; identical to SEQ ID NO: 199762
  derived and/or modified sequence opt5 from neuraminidase__InfluenzaA__ACY26194

SEQ ID NO: 200546 - RNA, 1410 nt, Artificial Sequence; identical to SEQ ID NO: 199762
  derived and/or modified sequence opt5 from neuraminidase__InfluenzaA__ACY26204

SEQ ID NO: 200547 - RNA, 1410 nt, Artificial Sequence; identical to SEQ ID NO: 199762
  derived and/or modified sequence opt5 from neuraminidase__InfluenzaA__ACY30123

SEQ ID NO: 200548 - RNA, 1410 nt, Artificial Sequence; identical to SEQ ID NO: 199762
  derived and/or modified sequence opt5 from neuraminidase__InfluenzaA__ACY30124

SEQ ID NO: 200549 - RNA, 1410 nt, Artificial Sequence; identical to SEQ ID NO: 199762
  derived and/or modified sequence opt5 from neuraminidase__InfluenzaA__ACY30125

SEQ ID NO: 200550 - RNA, 1410 nt, Artificial Sequence; identical to SEQ ID NO: 199762
  derived and/or modified sequence opt5 from neuraminidase__InfluenzaA__ACY30127

SEQ ID NO: 200551 - RNA, 1410 nt, Artificial Sequence; identical to SEQ ID NO: 199762
  derived and/or modified sequence opt5 from neuraminidase__InfluenzaA__ACY30128

SEQ ID NO: 200552 - RNA, 1410 nt, Artificial Sequence; identical to SEQ ID NO: 199762
  derived and/or modified sequence opt5 from neuraminidase__InfluenzaA__ACY46105

SEQ ID NO: 200553 - RNA, 1410 nt, Artificial Sequence; identical to SEQ ID NO: 199762
  derived and/or modified sequence opt5 from neuraminidase__InfluenzaA__ACY46165

SEQ ID NO: 200554 - RNA, 1410 nt, Artificial Sequence; identical to SEQ ID NO: 199762
  derived and/or modified sequence opt5 from neuraminidase__InfluenzaA__ACY46175

SEQ ID NO: 200555 - RNA, 1410 nt, Artificial Sequence; identical to SEQ ID NO: 199762
  derived and/or modified sequence opt5 from neuraminidase__InfluenzaA__ACY46345

SEQ ID NO: 200556 - RNA, 1410 nt, Artificial Sequence; identical to SEQ ID NO: 199762
  derived and/or modified sequence opt5 from neuraminidase__InfluenzaA__ACY46385

SEQ ID NO: 200557 - RNA, 1410 nt, Artificial Sequence; identical to SEQ ID NO: 199762
  derived and/or modified sequence opt5 from neuraminidase__InfluenzaA__ACY46485

SEQ ID NO: 200558 - RNA, 1410 nt, Artificial Sequence; identical to SEQ ID NO: 199792
  derived and/or modified sequence opt5 from neuraminidase__InfluenzaA__ACY77536

SEQ ID NO: 200559 - RNA, 1410 nt, Artificial Sequence; identical to SEQ ID NO: 199752
  derived and/or modified sequence opt5 from neuraminidase__InfluenzaA__ACY77546

SEQ ID NO: 200560 - RNA, 1410 nt, Artificial Sequence; identical to SEQ ID NO: 199792
  derived and/or modified sequence opt5 from neuraminidase__InfluenzaA__ACY77565

SEQ ID NO: 200561 - RNA, 1410 nt, Artificial Sequence
  derived and/or modified sequence opt5 from neuraminidase__InfluenzaA__ACY77575
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccuccgacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 200562 - RNA, 1410 nt, Artificial Sequence; identical to SEQ ID NO: 199762
  derived and/or modified sequence opt5 from neuraminidase__InfluenzaA__ACY77585

SEQ ID NO: 200563 - RNA, 1410 nt, Artificial Sequence; identical to SEQ ID NO: 199792
  derived and/or modified sequence opt5 from neuraminidase__InfluenzaA__ACY77595

SEQ ID NO: 200564 - RNA, 1410 nt, Artificial Sequence; identical to SEQ ID NO: 199792
  derived and/or modified sequence opt5 from neuraminidase__InfluenzaA__ACY77605

SEQ ID NO: 200565 - RNA, 1410 nt, Artificial Sequence; identical to SEQ ID NO: 199762
  derived and/or modified sequence opt5 from neuraminidase__InfluenzaA__ACY77625

SEQ ID NO: 200566 - RNA, 1410 nt, Artificial Sequence
  derived and/or modified sequence opt5 from neuraminidase__InfluenzaA__ACY77655
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcuucaacggggccaacggaguuaagggcuuuucuuucaaguauggcaaugggguguggaucggaagaacaaaauccauuagcucccggaacggcuuugagaugaucugggacccuaauggguggaccggaaccgauaacaauuucucuauuaagcaagacaucgucggcaucaacgaauggagcggguacuccggcucuuucgugcagcaucccgagcuuacaggacuggacuguauucgcccuugcuuuuggguugaacucaucagaggccggcccaaagagaauacgauuuggaccagcggguccagcaucucuuucuguggagugaacuccgauacagucggcuggagcuggcccgacggggcugagcugccuuuuaccauugauaaguga

SEQ ID NO: 200567 - RNA, 1410 nt, Artificial Sequence; identical to SEQ ID NO: 199762
  derived and/or modified sequence opt5 from neuraminidase__InfluenzaA__ACY77665

SEQ ID NO: 200568 - RNA, 1410 nt, Artificial Sequence; identical to SEQ ID NO: 199762
  derived and/or modified sequence opt5 from neuraminidase__InfluenzaA__ACY77675

SEQ ID NO: 200569 - RNA, 1410 nt, Artificial Sequence; identical to SEQ ID NO: 199752
  derived and/or modified sequence opt5 from neuraminidase__InfluenzaA__ACY77685

SEQ ID NO: 200570 - RNA, 1410 nt, Artificial Sequence; identical to SEQ ID NO: 199752
  derived and/or modified sequence opt5 from neuraminidase__InfluenzaA__ACY77695

SEQ ID NO: 200571 - RNA, 1410 nt, Artificial Sequence; identical to SEQ ID NO: 199752
  derived and/or modified sequence opt5 from neuraminidase__InfluenzaA__ACY77705

SEQ ID NO: 200572 - RNA, 1410 nt, Artificial Sequence; identical to SEQ ID NO: 199752
  derived and/or modified sequence opt5 from neuraminidase__InfluenzaA__ACY77725

SEQ ID NO: 200573 - RNA, 1410 nt, Artificial Sequence; identical to SEQ ID NO: 199752
  derived and/or modified sequence opt5 from neuraminidase__InfluenzaA__ACY77735

SEQ ID NO: 200574 - RNA, 1410 nt, Artificial Sequence; identical to SEQ ID NO: 199762
  derived and/or modified sequence opt5 from neuraminidase__InfluenzaA__ACY77745

SEQ ID NO: 200575 - RNA, 1410 nt, Artificial Sequence; identical to SEQ ID NO: 199762
  derived and/or modified sequence opt5 from neuraminidase__InfluenzaA__ACY77755

SEQ ID NO: 200576 - RNA, 1410 nt, Artificial Sequence; identical to SEQ ID NO: 199762
  derived and/or modified sequence opt5 from neuraminidase__InfluenzaA__ACY77775

SEQ ID NO: 200577 - RNA, 1410 nt, Artificial Sequence; identical to SEQ ID NO: 199762
  derived and/or modified sequence opt5 from neuraminidase__InfluenzaA__ACY77785

SEQ ID NO: 200578 - RNA, 1410 nt, Artificial Sequence; identical to SEQ ID NO: 199762
  derived and/or modified sequence opt5 from neuraminidase__InfluenzaA__ACY77795

SEQ ID NO: 200579 - RNA, 1410 nt, Artificial Sequence
  derived and/or modified sequence opt5 from neuraminidase__InfluenzaA__ACY77825
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgcgaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucaauucccggaacggcuucgagaugauuugggauccuaauggguggaccggaaccgacaacaauuuuucuaucaagcaagacaucguuggcauuaacgaauggagcggguacuccggcucuuucgugcagcaucccgagcuuacaggacuggauuguauccgcccuugcuucugggucgaacucauuagaggccggcccaaagagaauacgaucuggaccagcggguccagcauuucuuuuuguggagugaacuccgacacaguuggcuggagcuggcccgauggggccgagcugccuuucaccaucgacaaguga

SEQ ID NO: 200580 - RNA, 1410 nt, Artificial Sequence; identical to SEQ ID NO: 200579
  derived and/or modified sequence opt5 from neuraminidase__InfluenzaA__ACY77835

SEQ ID NO: 200581 - RNA, 1410 nt, Artificial Sequence; identical to SEQ ID NO: 199792
  derived and/or modified sequence opt5 from neuraminidase__InfluenzaA__ACY77845

SEQ ID NO: 200582 - RNA, 1410 nt, Artificial Sequence; identical to SEQ ID NO: 199762
  derived and/or modified sequence opt5 from neuraminidase__InfluenzaA__ACY77865

SEQ ID NO: 200583 - RNA, 1410 nt, Artificial Sequence
  derived and/or modified sequence opt5 from neuraminidase__InfluenzaA__ACY77870
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaaccuugcugccgggcagagcguggucuccgugaaacuggcgggaaauucuagccucugcccuguuuccggcugggcuauuuacagcaaggacaacucuaucagaaucggguccaaaggagauguguucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccuugaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuuuguccagcaucccgagcugacaggacucgauuguauccgcccuugcuucuggguggaacugauuagaggccggcccaaagagaacacgaucuggaccuccgggagcucuauuuccuucuguggaguuaauagcgacacagugggcuggucuuggcccgauggggcugagcuuccuuuuaccaucgacaaguga

SEQ ID NO: 200584 - RNA, 1410 nt, Artificial Sequence; identical to SEQ ID NO: 199762
  derived and/or modified sequence opt5 from neuraminidase__InfluenzaA__ACY77877

SEQ ID NO: 200585 - RNA, 1410 nt, Artificial Sequence; identical to SEQ ID NO: 199762
  derived and/or modified sequence opt5 from neuraminidase__InfluenzaA__ACY77887

SEQ ID NO: 200586 - RNA, 1410 nt, Artificial Sequence; identical to SEQ ID NO: 199762
  derived and/or modified sequence opt5 from neuraminidase__InfluenzaA__ACY77907

SEQ ID NO: 200587 - RNA, 1410 nt, Artificial Sequence; identical to SEQ ID NO: 199792
  derived and/or modified sequence opt5 from neuraminidase__InfluenzaA__ACY77917

SEQ ID NO: 200588 - RNA, 1410 nt, Artificial Sequence
  derived and/or modified sequence opt5 from neuraminidase__InfluenzaA__ACY77927
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccuaacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200589 - RNA, 1410 nt, Artificial Sequence; identical to SEQ ID NO: 199762
  derived and/or modified sequence opt5 from neuraminidase__InfluenzaA__ACY77937

SEQ ID NO: 200590 - RNA, 1410 nt, Artificial Sequence; identical to SEQ ID NO: 199762
  derived and/or modified sequence opt5 from neuraminidase__InfluenzaA__ACY77947

SEQ ID NO: 200591 - RNA, 1410 nt, Artificial Sequence; identical to SEQ ID NO: 199762
  derived and/or modified sequence opt5 from neuraminidase__InfluenzaA__ACY77967

SEQ ID NO: 200592 - RNA, 1410 nt, Artificial Sequence; identical to SEQ ID NO: 199752
  derived and/or modified sequence opt5 from neuraminidase__InfluenzaA__ACY77977

SEQ ID NO: 200593 - RNA, 1410 nt, Artificial Sequence; identical to SEQ ID NO: 199762
  derived and/or modified sequence opt5 from neuraminidase__InfluenzaA__ACY77987

SEQ ID NO: 200594 - RNA, 1410 nt, Artificial Sequence
  derived and/or modified sequence opt5 from neuraminidase__InfluenzaA__ACY77997
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugacccuugcgggaaauucuagccugugcccuguuuccggcugggcuauuuacagcaaagacaacucuaucagaaucggguccaagggagauguguuugucauucgggagccguucaucagcuguucuccccucgaaugccgcacauuuuuccugacccagggcgcccuucugaaugacaaacauuccaacggcacgauuaaggauagaagcccuuaucggacccucaugucuugucccaucggggaggugccuucccccuacaacagccgcuuugaauccguugccuggucugcuagcgccugccacgacggaauuaauuggcugacaaucggcaucuccgggccugauaacggagcuguggccguccugaaauauaauggcauuaucaccgacacaauuaagagcuggagaaacaauauccuccggacccaagagucugagugugcgugcgugaacggguccuguuucacggugaugacagauggaccgagcgacggccaggccucuuacaagauuuuucgcaucgaaaaaggcaagaucgucaaaagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaagacaggauccugcggcccggucagcucuaauggggccaacggagugaaaggcuucuccuuuaaguauggcaacgggguuuggauuggaagaaccaagagcaucuccucucggaauggcuucgagaugauuugggauccuaacggguggaccggaacagacaauaacuuuagcaucaaacaagacaucgugggcauuaaugaaugguccggguacucuggcagcuucguccagcaucccgagcuuacgggacuggauuguauccgcccuugcuucuggguggaacucauuagaggccggcccaaggagaacaccaucuggacauccgggagcucuauuuccuuuuguggaguuaauagcgacaccgugggcuggucuuggcccgauggggcugagcugccuuucacaaucgacaaauga

SEQ ID NO: 200595 - RNA, 1410 nt, Artificial Sequence; identical to SEQ ID NO: 199762
  derived and/or modified sequence opt5 from neuraminidase__InfluenzaA__ACY78017

SEQ ID NO: 200596 - RNA, 1410 nt, Artificial Sequence
  derived and/or modified sequence opt5 from neuraminidase__InfluenzaA__ACZ01955
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccuggaaacggcgcuguggccguccugaaguauaaugggauuaucacagauaccauuaagagcuggagaaacaauauccuccggacacaagagucugagugugcgugcgugaacggauccuguuucaccgugaugacggacggcccgagcgauggccaggccucuuacaaaauuuuucgcaucgaaaaggggaaaaucgucaagagcguugagaugaaugcucccaacuaucauuacgaagagugcuccuguuacccugacucuagcgagauuacaugcgugugcagagauaauuggcacggauccaaccggcccugggugagcuucaaucagaaccuggaauaucagaucggcuacauuuguucugggaucuuuggagacaauccucgccccaacgauaaaaccggcuccugcgggccggucagcucuaauggagccaacggcgugaagggcuucuccuuuaaguaugggaacggaguuuggauuggcagaacaaaaagcaucuccucucggaauggguucgagaugauuugggacccuaacggauggaccggcaccgauaauaacuuuagcaucaagcaagacaucguggggauuaaugaaugguccggcuacucuggcagcuucguccagcaucccgagcuuacaggacuggacuguauccgcccuugcuucuggguggaacucauuagagggcggcccaaagagaacacgaucuggaccuccggaagcucuauuuccuuuuguggcguuaauagcgauacagugggguggucuuggcccgacggagcugagcugccuuucaccaucgauaaguga

SEQ ID NO: 200597 - RNA, 1410 nt, Artificial Sequence; identical to SEQ ID NO: 199762
  derived and/or modified sequence opt5 from neuraminidase__InfluenzaA__ACZ05053

SEQ ID NO: 200598 - RNA, 1410 nt, Artificial Sequence; identical to SEQ ID NO: 199752
  derived and/or modified sequence opt5 from neuraminidase__InfluenzaA__ACZ05064

SEQ ID NO: 200599 - RNA, 1410 nt, Artificial Sequence; identical to SEQ ID NO: 199762
  derived and/or modified sequence opt5 from neuraminidase__InfluenzaA__ACZ05074

SEQ ID NO: 200600 - RNA, 1410 nt, Artificial Sequence; identical to SEQ ID NO: 199762
  derived and/or modified sequence opt5 from neuraminidase__InfluenzaA__ACZ05084

SEQ ID NO: 200601 - RNA, 1410 nt, Artificial Sequence; identical to SEQ ID NO: 199762
  derived and/or modified sequence opt5 from neuraminidase__InfluenzaA__ACZ05094

SEQ ID NO: 200602 - RNA, 1410 nt, Artificial Sequence; identical to SEQ ID NO: 199762
  derived and/or modified sequence opt5 from neuraminidase__InfluenzaA__ACZ05104

SEQ ID NO: 200603 - RNA, 1410 nt, Artificial Sequence; identical to SEQ ID NO: 199762
  derived and/or modified sequence opt5 from neuraminidase__InfluenzaA__ACZ05114

SEQ ID NO: 200604 - RNA, 1410 nt, Artificial Sequence; identical to SEQ ID NO: 199762
  derived and/or modified sequence opt5 from neuraminidase__InfluenzaA__ACZ05124

SEQ ID NO: 200605 - RNA, 1410 nt, Artificial Sequence; identical to SEQ ID NO: 199762
  derived and/or modified sequence opt5 from neuraminidase__InfluenzaA__ACZ05144

SEQ ID NO: 200606 - RNA, 1410 nt, Artificial Sequence; identical to SEQ ID NO: 199762
  derived and/or modified sequence opt5 from neuraminidase__InfluenzaA__ACZ05154

SEQ ID NO: 200607 - RNA, 1410 nt, Artificial Sequence; identical to SEQ ID NO: 199623
  derived and/or modified sequence opt5 from neuraminidase__InfluenzaA__ACZ05164

SEQ ID NO: 200608 - RNA, 1410 nt, Artificial Sequence; identical to SEQ ID NO: 199623
  derived and/or modified sequence opt5 from neuraminidase__InfluenzaA__ACZ05175

SEQ ID NO: 200609 - RNA, 1413 nt, Artificial Sequence
  derived and/or modified sequence opt5 from neuraminidase__InfluenzaA__ACZ05197
augaaccccaaucagaagaucaugaccauuggcagcaucuccauugccaucgggauuaucucucugaugcuccaaaucggaaacauuaucagcauuugggcuucccacucuauccagacaggcagccagaauaacacggggauuugcaaucagagaaucauuaccuacgagaacuccacaugggugaaucauaccuaugugaacaucaauaacacaaauguuguggccggagaagacaaaaccucugugacacuggcgggcaacagcucccuuuguagcaucucugggugggcuauuuacaccaaggauaauuccauccggauuggaagcaaaggcgacgucuucgugauccgcgagccuuuuauuucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaaucagcggcccugacaacggggcggucgccgugcugaaguauaauggaauuaucacaggcaccauuaaaucuuggaagaaacagauccucagaacgcaggaguccgagugcguuuguaugaacggcagcugcuuuacaauuaugaccgaugggcccucuaauaaggcugccagcuacaaaaucuucaagaucgaaaagggaaaagugacaaaguccauugagcugaacgcuccuaauuuuuauuacgaagaguguucuugcuacccggacaccggcaucgucaugugugugugccgggauaacuggcaugggagcaaucgccccuggguguccuucaaccagaaucuugacuaucaaauuggauacaucugcagcggcgucuuuggggauaacccuagacccgaggacggagaaggcucuuguaauccuguuaccguggauggcgccaacggggugaaaggauucuccuauaaguacggcaauggggucuggauuggacggacaaaaagcaaccgccugagaaagggcuuugagaugaucugggaccccaauggguggacgaacaccgacucugauuucuccgugaaacaggacguuguggcgauuacagauuggagcggcuauuccggaucuuuuguccagcacccggaacucaccggccuggacugcauccggccuuguuucuggguggagcuuguucgcgggcugcccagagaaaacacaaccaucuggacgagcggauccucuauuagcuucugcggcgucaauuccgauacagccaacuggagcuggccugacggggcugagcuccccuuuaccaucgauaaguga

SEQ ID NO: 200610 - RNA, 1410 nt, Artificial Sequence
  derived and/or modified sequence opt5 from neuraminidase__InfluenzaA__ACZ05208
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugcagcgacccgaacaaugaggaaggcgggcacggagugaaaggcugggccuucgauucugggaacgacguuuggaugggacgcaccaucuccgagaagucuagacugggcuaugagacauuuaaagugaucgaaggguggucuaauccuaaguccaaacuccagauuaaccggcaggucaucguggaucgcggaaauagaagcggcuacuccggcauuuucucugucgagggaaagagcuguaucaaccggugcuuuuauguggaacugauuagagggcgcaaggaggaaaccgagguucuguggaccuccaauucuaucguggucuucuguggcacaagcgggaccuacggaacaggcuccuggcccgacggggcugauauuaaccucaugccuaucuga

SEQ ID NO: 200611 - RNA, 1410 nt, Artificial Sequence
  derived and/or modified sequence opt5 from neuraminidase__InfluenzaA__ACZ05219
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugggauuaccggauucgccccuuuuucuaaagacaacagcauccgccuguccgcgggcggggauaucugggugacaagagagcccuaugucucuugcgacccugauaaguguuaccaauucgcucuuggacagggcaccacacugaauaacgugcauagcaauaacaccguucgggaccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagagauccugcgcacccaggaaucugagugugugugcauuaacggaacauguacgguggucaugaccgauggcuccgcuagcgggaaggccgacacaaaaauccucuuuaucgaggaaggaaagauuguucauaccuccacacugucuggcagcgcgcaacacguggaggaaugcuccugcuauccuagauaccccggggugcggugugucugccgcgauaacuggaagggaagcaauagaccuaucguggacauuaacaucaaagaucacucuauuguuuccagcuacguguguucuggccuugucggcgacacgccccggaagaaugacagcuccucuagcucccauugccuggauccgaacaaugaggaagggggacacggcgugaaagggugggccuucgacgauggaaacgacguuuggaugggccgcaccaucagcgagaagucuagacucggguaugagacauuuaaagugaucgaaggaugguccaauccuaagagcaaacugcagauuaaccggcaggucaucguggaucgcggcaauagaucuggcuacuccgggauuuucagcgucgagggaaaguccuguaucaaccggugcuuuuauguggaacugauuagaggccgcaaggaggaaaccgagguucucuggaccucuaauagcaucguggucuucugugggacauccggaaccuacggcacagggucuuggcccgacggcgcugauauuaaccugaugccuaucuga

SEQ ID NO: 200612 - RNA, 1410 nt, Artificial Sequence; identical to SEQ ID NO: 199623
  derived and/or modified sequence opt5 from neuraminidase__InfluenzaA__ACZ05230

SEQ ID NO: 200613 - RNA, 1410 nt, Artificial Sequence
  derived and/or modified sequence opt5 from neuraminidase__InfluenzaA__ACZ05241
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccaagcugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaauccuaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggcccgauggggcugacauuaaccugaugccuaucuga

SEQ ID NO: 200614 - RNA, 1413 nt, Artificial Sequence
  derived and/or modified sequence opt5 from neuraminidase__InfluenzaA__ACZ05296
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguugccguggauggcgcgaacggggugaaaggauucuccuauaaguacggcaauggggucuggaucggacggaccaaaagcaaccgccugagaaagggcuuugagaugauuugggaccccaauggguggacaaacacggacucugauuucuccgugaaacaggacguuguggccaucaccgauuggagcggcuauuccggaucuuuuguccagcacccggaacucacaggccuggacugcauccggccuuguuucuggguggagcuuguucgcgggcugcccagagaaaacaccacaauuuggaccagcggauccucuaucagcuucugcggcgucaauuccgauacggcuaacuggagcuggccugacggggccgagcuccccuuuacaauugauaaguga

SEQ ID NO: 200615 - RNA, 1410 nt, Artificial Sequence; identical to SEQ ID NO: 199623
  derived and/or modified sequence opt5 from neuraminidase__InfluenzaA__ACZ05307

SEQ ID NO: 200616 - RNA, 1410 nt, Artificial Sequence
  derived and/or modified sequence opt5 from neuraminidase__InfluenzaA__ACZ05318
augaaccccaaucagaagaucauuaccaucggcagcgugucccugacaauuucuacgaucugcuucuuuaugcaaaccgccauucucaucacaaccgucacacugcacuucaaacagugugaguuuaacagcccuccgaauaaccagguuaugcuuugcgaacccaccaucauugagagaaauaucacagaaauuguguaccugaccaacacgaccaucgagaaggaaauuuguccuaaacucgcugaguaucggaauugguccaagccccagugcgacaucacaggguucgccccuuuuucuaaagauaacagcauucgccuguccgcgggaggcgacaucugggugaccagagagcccuacgucucuugugauccugacaagugcuaucaauucgcucuugggcagggaacaacccugaauaacgugcauagcaauaacacgguucgggaucgcacaccguacagaacccuccugaugaaugaacugggcgugcccuuucaccucgggacaaagcaggucuguaucgccugguccucuagcuccugccaugacggaaaagccuggcugcacguguguauuaccggcgaugacaagaacgcuaccgccagcuucaucuauaauggccggcuuguugauucuguggucuccuggagcaaagagauucugcgcacacaggaaucugagugcguguguaucaacgggacgugcaccguggucaugacagacggauccgcuagcggcaaggccgauaccaaaauucucuuuaucgaggaagggaagaucguucauacauccacccugucuggaagcgcgcaacacguggaggaaugcuccuguuacccuagauaucccggcgugcggugcgucugucgcgacaacuggaaggggagcaauagaccuauuguggauaucaacauuaaagaccacucuaucguuuccagcuacgugugcucuggacuugucggcgacacgccccggaagaaugauagcuccucuagcucccauugucuggacccgaacaaugaggaaggcgggcacggagugaaaggcugggccuucgaugacgggaacgauguuuggaugggacgcacaauuagcgagaagucuagacucggcuacgagaccuuuaaagugaucgaagggugguccaauccuaagagcaaacugcagaucaaccggcaggucauuguggaccgcggaaauagaucuggcuauuccggcaucuucagcgucgaggggaaguccugcauuaaccgguguuuuuacguggaacugaucagaggacgcaaggaggaaaccgagguucucuggacaucuaauagcauuguggucuucugcggcaccuccgggacauauggaacgggcucuuggcccgauggggcugacaucaaccugaugccuauuuga

SEQ ID NO: 200617 - RNA, 1410 nt, Artificial Sequence; identical to SEQ ID NO: 199623
  derived and/or modified sequence opt5 from neuraminidase__InfluenzaA__ACZ05329

SEQ ID NO: 200618 - RNA, 1410 nt, Artificial Sequence; identical to SEQ ID NO: 199536
  derived and/or modified sequence opt5 from neuraminidase__InfluenzaA__ACZ05340

SEQ ID NO: 200619 - RNA, 1410 nt, Artificial Sequence; identical to SEQ ID NO: 200613
  derived and/or modified sequence opt5 from neuraminidase__InfluenzaA__ACZ05362

SEQ ID NO: 200620 - RNA, 1410 nt, Artificial Sequence; identical to SEQ ID NO: 199623
  derived and/or modified sequence opt5 from neuraminidase__InfluenzaA__ACZ05373

SEQ ID NO: 200621 - RNA, 1410 nt, Artificial Sequence; identical to SEQ ID NO: 199623
  derived and/or modified sequence opt5 from neuraminidase__InfluenzaA__ACZ05395

SEQ ID NO: 200622 - RNA, 1410 nt, Artificial Sequence; identical to SEQ ID NO: 199623
  derived and/or modified sequence opt5 from neuraminidase__InfluenzaA__ACZ05406

SEQ ID NO: 200623 - RNA, 1413 nt, Artificial Sequence
  derived and/or modified sequence opt5 from neuraminidase__InfluenzaA__ACZ05450
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcguccggauuggaucuaaaggcgacguguucguuauccgcgagccuuuuauuuccugcagccaccuggaauguagaacguucuuucucacccaaggcgcccugcuuaaugauaagcauucuaacgggacagugaaagaccgguccccguaucgcgcccugaugagcugcccccucggagaggcuccuucccccuacaauucuaaguucgaaagcgucgccugguccgcuagcgccugucacgauggcaugggguggcugaccaucggaaucucuggcccugacaacggggcgguggccguucugaaguauaacggaauuaucacaggcaccauuaaauccuggaagaaacagauccucagaacgcaggagagcgagugcguguguaugaauggcucuugcuuuacaauuaugaccgaugggcccagcaacaaggcugccuccuacaaaaucuucaagaucgaaaagggaaaagucacaaagucuauugagcugaaugcuccuaacuuuuauuacgaagaguguagcugcuacccggacaccggcaucgugaugugugugugccgggauaauuggcauggguccaaccgccccugggucagcuucaaucagaaccuugacuaucaaauuggauacaucugcucuggcguuuuuggggauaauccuagacccgaggacggagaaggcuccuguaacccugugaccguggauggcgccaauggggucaaaggauucagcuauaaguacggcaacgggguguggauuggacggacaaaaucuaaucgccugagaaagggcuuugagaugaucugggaccccaacggguggacgaauaccgacuccgauuucagcguuaaacaggacguggucgcgauuacagauugguccggcuauucuggaucuuuugugcagcacccggaacucaccggccuggacugcauccggccuuguuucuggguugagcuugugcgcgggcugcccagagaaaacacaaccaucuggacguccggaucuagcauuuccuucugcggcgucaacagcgauacagccaauuggucuuggccugacggggcugagcuccccuuuaccaucgauaaguga

SEQ ID NO: 200624 - RNA, 1410 nt, Artificial Sequence; identical to SEQ ID NO: 199623
  derived and/or modified sequence opt5 from neuraminidase__InfluenzaA__ACZ05461

SEQ ID NO: 200625 - RNA, 1410 nt, Artificial Sequence; identical to SEQ ID NO: 199623
  derived and/or modified sequence opt5 from neuraminidase__InfluenzaA__ACZ05472

SEQ ID NO: 200626 - RNA, 1410 nt, Artificial Sequence
  derived and/or modified sequence opt5 from neuraminidase__InfluenzaA__ACZ05483
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgguggagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugagacauuuaaagucaucgaagggugguccaauccuaagagcaaacugcagaucaaccgccaggugauugucgaccggggaaauagaucuggcuacuccggcaucuucagcguggaggggaaguccuguauuaaccggugcuuuuauguugaacugaucagaggacgcaaggaggaaaccgaggugcucuggaccucuaauagcauugucguguucuguggcacauccgggaccuacggaacaggcucuuggcccgauggggcugacaucaaccugaugccuauuuga

SEQ ID NO: 200627 - RNA, 1410 nt, Artificial Sequence; identical to SEQ ID NO: 199623
  derived and/or modified sequence opt5 from neuraminidase__InfluenzaA__ACZ05494

SEQ ID NO: 200628 - RNA, 1410 nt, Artificial Sequence; identical to SEQ ID NO: 200616
  derived and/or modified sequence opt5 from neuraminidase__InfluenzaA__ACZ05516

SEQ ID NO: 200629 - RNA, 1410 nt, Artificial Sequence
  derived and/or modified sequence opt5 from neuraminidase__InfluenzaA__ACZ05527
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugcagcgacccgaacaaugaggaaggcgggcacggagugaaaggcugggccuucgaugacgggaacgauguuuggaugggacgcaccaucucugagaaguccagacugggcuaugagacauuuaaagugaucgaaggguggagcaauccuaagucuaaacuccagauuaaccggcaggucaucguggaccgcggaaauagauccggcuacagcggcauuuucuccgucgaggggaagucuuguaucaaccggugcuuuuauguggaacugauuagaggacgcaaggaggaaaccgagguucuguggaccagcaauuccaucguggucuucuguggcacaucugggaccuacggaacaggcagcuggcccgauggggcugacauuaaccucaugccuaucuga

SEQ ID NO: 200630 - RNA, 1410 nt, Artificial Sequence; identical to SEQ ID NO: 200613
  derived and/or modified sequence opt5 from neuraminidase__InfluenzaA__ACZ05538

SEQ ID NO: 200631 - RNA, 1413 nt, Artificial Sequence; identical to SEQ ID NO: 200485
  derived and/or modified sequence opt5 from neuraminidase__InfluenzaA__ACZ05593

SEQ ID NO: 200632 - RNA, 1413 nt, Artificial Sequence
  derived and/or modified sequence opt5 from neuraminidase__InfluenzaA__ACZ05604
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauucgggggugggcuaucuacaccaaggauaauucuauucgcaucggauccaaaggcgacgucuucgugauuagagagccuuuuaucagcugcucucaccuggaaugucggacguucuuucucacccaaggcgcccugcuuaacgauaagcauuccaaugggacaguuaaagaccgcagcccguauagagcccugaugucuugcccccucggagaggcuccuucccccuacaacagcaaguucgaauccguggccuggucugcuagcgccugucacgauggcaugggguggcugaccaucggaauuuccggcccugacaacggggcggucgccgugcugaaguauaauggaaucauuacaggcaccaucaaaagcuggaagaaacagauucuccggacgcaggagucugagugcguuuguaugaacggcuccugcuuuacaaucaugaccgaugggcccagcaauaaggcugccucuuacaaaaucuucaagauugaaaagggaaaagugacaaagagcaucgagcugaacgcuccuaauuuuuauuacgaagaguguuccugcuacccggacaccggcauugucaugugugugugccgcgauaacuggcaugggucuaauagacccugggugagcuucaaccagaaucuugacuaucaaaucggauacauuugcuccggcgucuuuggggauaacccucggcccgaggacggagaaggcagcuguaauccuguuaccguggauggcgccaacggggugaaaggauucucuuauaaguacggcaauggggucuggaucggacgcacaaaauccaacagacugcggaagggcuuugagaugauuugggaccccaauggguggacgaacaccgacagcgauuucucugugaaacaggacguuguggcgaucacagauugguccggcuauagcggauccuuuguccagcacccggaacucaccggccuggacugcauccgcccuuguuucuggguggagcuuguuagagggcugccccgggaaaacacaaccauuuggacgucuggaagcuccaucucuuucugcggcgugaauagcgauacagccaacugguccuggccugacggggcugagcuccccuuuaccauugauaaguga

SEQ ID NO: 200633 - RNA, 1410 nt, Artificial Sequence; identical to SEQ ID NO: 199623
  derived and/or modified sequence opt5 from neuraminidase__InfluenzaA__ACZ05953

SEQ ID NO: 200634 - RNA, 1410 nt, Artificial Sequence; identical to SEQ ID NO: 200629
  derived and/or modified sequence opt5 from neuraminidase__InfluenzaA__ACZ05964

SEQ ID NO: 200635 - RNA, 1410 nt, Artificial Sequence; identical to SEQ ID NO: 199623
  derived and/or modified sequence opt5 from neuraminidase__InfluenzaA__ACZ05997

SEQ ID NO: 200636 - RNA, 1410 nt, Artificial Sequence; identical to SEQ ID NO: 200629
  derived and/or modified sequence opt5 from neuraminidase__InfluenzaA__ACZ06008

SEQ ID NO: 200637 - RNA, 1410 nt, Artificial Sequence; identical to SEQ ID NO: 200629
  derived and/or modified sequence opt5 from neuraminidase__InfluenzaA__ACZ06019

SEQ ID NO: 200638 - RNA, 1413 nt, Artificial Sequence
  derived and/or modified sequence opt5 from neuraminidase__InfluenzaA__ACZ16015
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaaguguccaagucuaucgagcugaacgcuccuaauuuuuauuacgaagaguguagcugcuacccggacacaggcauugucaugugugugugccgggauaacuggcauggguccaaucgccccugggugagcuucaaccagaaucuugacuaucaaaucggauacauuugcucuggcgucuuuggggauaacccuagacccgaggacggagaaggcuccuguaauccuguuaccguggauggcgccaacggggugaaaggauucagcuauaaguacggcaauggggucuggaucggacggaccaaaucuaaccgccugagaaagggcuuugagaugauuugggaccccaauggguggacaaacacggacuccgauuucagcgugaaacaggacguuguggcgaucaccgauugguccggcuauucuggcagcuuuguccagcacccggaacucacaggacuggacugcauccggccuuguuucuggguggagcuuguucgcgggcugcccagagaaaacaccacaauuuggaccuccggaucuagcaucuccuucugcggcgugaauagcgauacggccaacuggucuuggccugacggggcugagcuccccuuuacaauugauaaguga

SEQ ID NO: 200639 - RNA, 1413 nt, Artificial Sequence
  derived and/or modified sequence opt5 from neuraminidase__InfluenzaA__ACZ16025
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaaucaaagaccggucuccguaucgcgcccugauguccugcccccucggagaggcuccuagccccuacaacuccaaguucgaaucuguugccuggagcgcuuccgccugucacgauggcaugggguggcugaccauuggaaucagcggcccugacaacggggcgguggccguccugaaguauaauggaauuaucacaggcaccauuaaaucuuggaagaaacagauccucagaacgcaggaguccgagugcguguguaugaacggcagcugcuuuacaaucaugaccgaugggcccucuaauaaggcugccagcuacaaaauuuucaagaucgaaaagggaaaaguuacaaaguccauugagcugaacgcuccuaauuuuuauuacgaagaguguucuugcuacccggacaccggcaucgugaugugugucugccgggauaacuggcaugggagcaaucgccccuggguguccuucaaccagaaucuugacuaucaaauuggauacaucugcagcggcguguuuggggauaacccuagacccgaggacggagaaggcucuuguaauccugucaccguugauggcgccaacggggugaaaggauucuccuauaaguacggcaaugggguguggauuggacggacaaaaagcaaccgccugagaaagggcuuugagaugaucugggaccccaauggguggacgaacaccgacucugauuucuccgucaaacaggacgugguugcgaucacagauuggagcggcuauuccggaucuuuugugcagcacccggaacucaccggccuggacugcauucggccuuguuucugggucgagcuugugcgcgggcugcccagagaaaacacaaccaucuggacgagcggauccucuauuagcuucugcggcguuaauuccgauacagccaacuggagcuggccugacggggcugagcuccccuuuaccaucgauaaguga

SEQ ID NO: 200640 - RNA, 1413 nt, Artificial Sequence; identical to SEQ ID NO: 200485
  derived and/or modified sequence opt5 from neuraminidase__InfluenzaA__ACZ16035

SEQ ID NO: 200641 - RNA, 1410 nt, Artificial Sequence
  derived and/or modified sequence opt5 from neuraminidase__InfluenzaA__ACZ16043
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacaauaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 200642 - RNA, 1410 nt, Artificial Sequence
  derived and/or modified sequence opt5 from neuraminidase__InfluenzaA__ACZ16053
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuuccucucggaacggcuucgagaugaucugggacccuaauggguggaccggaaccgauaacaauuuuagcacaaagcaagacauugucggcaucaacgaaugguccggguacucuggcagcuucgugcagcaucccgagcuuacgggacuggacuguauccgcccuugcuucuggguugaacucauuagaggccggcccaaagagaauaccaucuggacauccgggagcucuauuuccuuuuguggagugaacagcgauaccgucggcuggucuuggcccgacggggcugagcugccuuucacaaucgauaaguga

SEQ ID NO: 200643 - RNA, 1410 nt, Artificial Sequence; identical to SEQ ID NO: 199752
  derived and/or modified sequence opt5 from neuraminidase__InfluenzaA__ACZ16073

SEQ ID NO: 200644 - RNA, 1410 nt, Artificial Sequence
  derived and/or modified sequence opt5 from neuraminidase__InfluenzaA__ACZ16083
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccagacagagcguggucuccgugaaacuugcgggaaauucuagccugugcccuguuuccgggugggcuauuuacagcaaggacaacucugugcggaucggcuccaaaggggaugucuuugugauccgcgagccguucauuagcuguucuccccucggaugcagaaccuuuuuccugacacagggcgcccuucugaaugacaagcauuccaacggcaccaucaaagaucggagcccuuaucgcacgcucaugucuugucccauuggggaaguuccuucccccuacaacagcagauuugaguccguggccuggucugcuagcgccugccacgacggaaucaauuggcugaccauuggcaucuccgggccugauaacggagcugucgccgugcugaaguauaauggcaucauuacagacaccaucaagagcuggcggaacaauauucuccgcacacaagaaucugagugugcgugcgugaacggguccuguuucaccgucaugacggauggaccgagcaauggccaggccucuuacaaaaucuuuagaauugagaagggcaaaaucguuaagagcguggaaaugaacgcucccaauuaucauuacgaggaaugcuccuguuacccugacucuagcgagaucacaugcgugugccgggauaacuggcacggguccaaucgccccugggucagcuucaaccagaaucuggaguaucagauuggauacaucuguucuggcauuuuuggggacaacccuagacccaaugauaaaaccggauccugcggcccggugagcucuaacggggccaacggaguuaagggcuucuccuuuaaguauggcaaugggguguggaucggacggacaaaaagcauuuccucucgcaacggcuucgaaaugaucugggacccuaauggguggaccggaaccgauaacaauuuuagcauuaagcaagacaucgucggcaucaacgagugguccggguacucuggcagcuucgugcagcaucccgaacuuacaggacuggacuguauuagaccuugcuucuggaucgagcucauucggggccgccccaaagaaaauacgaucuggaccuccgggagcucuauuuccuuuuguggaguuaacagcgauacagugggcuggucuuggcccgacggggcugagcugccuuucaccaucgauaaguga

SEQ ID NO: 200645 - RNA, 1410 nt, Artificial Sequence; identical to SEQ ID NO: 199752
  derived and/or modified sequence opt5 from neuraminidase__InfluenzaA__ACZ16093

SEQ ID NO: 200646 - RNA, 1410 nt, Artificial Sequence; identical to SEQ ID NO: 199762
  derived and/or modified sequence opt5 from neuraminidase__InfluenzaA__ACZ16103

SEQ ID NO: 200647 - RNA, 1410 nt, Artificial Sequence; identical to SEQ ID NO: 199762
  derived and/or modified sequence opt5 from neuraminidase__InfluenzaA__ACZ16113

SEQ ID NO: 200648 - RNA, 1410 nt, Artificial Sequence; identical to SEQ ID NO: 199762
  derived and/or modified sequence opt5 from neuraminidase__InfluenzaA__ACZ16123

SEQ ID NO: 200649 - RNA, 1410 nt, Artificial Sequence
  derived and/or modified sequence opt5 from neuraminidase__InfluenzaA__ACZ16133
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 200650 - RNA, 1410 nt, Artificial Sequence
  derived and/or modified sequence opt5 from neuraminidase__InfluenzaA__ACZ16143
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccgcuuagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcuuccuuucaccaucgacaaguga

SEQ ID NO: 200651 - RNA, 1410 nt, Artificial Sequence; identical to SEQ ID NO: 199762
  derived and/or modified sequence opt5 from neuraminidase__InfluenzaA__ACZ16153

SEQ ID NO: 200652 - RNA, 1410 nt, Artificial Sequence; identical to SEQ ID NO: 199762
  derived and/or modified sequence opt5 from neuraminidase__InfluenzaA__ACZ16163

SEQ ID NO: 200653 - RNA, 1410 nt, Artificial Sequence; identical to SEQ ID NO: 199752
  derived and/or modified sequence opt5 from neuraminidase__InfluenzaA__ACZ16173

SEQ ID NO: 200654 - RNA, 1410 nt, Artificial Sequence; identical to SEQ ID NO: 199762
  derived and/or modified sequence opt5 from neuraminidase__InfluenzaA__ACZ16193

SEQ ID NO: 200655 - RNA, 1410 nt, Artificial Sequence; identical to SEQ ID NO: 199762
  derived and/or modified sequence opt5 from neuraminidase__InfluenzaA__ACZ16203

SEQ ID NO: 200656 - RNA, 1410 nt, Artificial Sequence; identical to SEQ ID NO: 199762
  derived and/or modified sequence opt5 from neuraminidase__InfluenzaA__ACZ16213

SEQ ID NO: 200657 - RNA, 1410 nt, Artificial Sequence
  derived and/or modified sequence opt5 from neuraminidase__InfluenzaA__ACZ16223
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacgagaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucauuggaaucaaugagugguccggcuacucugggagcuucgugcagcaucccgaacuuacaggccuggauuguauucgcccuugcuucugggucgagcucaucagaggacggcccaaagagaacacgauuuggaccuccggcagcucuaucuccuuuuguggggugaauagcgacacaguuggauggucuuggcccgauggcgcugaacugccuuucaccaucgacaaguga

SEQ ID NO: 200658 - RNA, 1410 nt, Artificial Sequence; identical to SEQ ID NO: 199762
  derived and/or modified sequence opt5 from neuraminidase__InfluenzaA__ACZ16233

SEQ ID NO: 200659 - RNA, 1410 nt, Artificial Sequence; identical to SEQ ID NO: 200470
  derived and/or modified sequence opt5 from neuraminidase__InfluenzaA__ACZ16243

SEQ ID NO: 200660 - RNA, 1410 nt, Artificial Sequence
  derived and/or modified sequence opt5 from neuraminidase__InfluenzaA__ACZ16253
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaacaucgacaaguga

SEQ ID NO: 200661 - RNA, 1410 nt, Artificial Sequence; identical to SEQ ID NO: 199762
  derived and/or modified sequence opt5 from neuraminidase__InfluenzaA__ACZ16263

SEQ ID NO: 200662 - RNA, 1410 nt, Artificial Sequence; identical to SEQ ID NO: 199752
  derived and/or modified sequence opt5 from neuraminidase__InfluenzaA__ACZ16283

SEQ ID NO: 200663 - RNA, 1410 nt, Artificial Sequence; identical to SEQ ID NO: 199762
  derived and/or modified sequence opt5 from neuraminidase__InfluenzaA__ACZ16293

SEQ ID NO: 200664 - RNA, 1410 nt, Artificial Sequence; identical to SEQ ID NO: 199762
  derived and/or modified sequence opt5 from neuraminidase__InfluenzaA__ACZ16303

SEQ ID NO: 200665 - RNA, 1410 nt, Artificial Sequence; identical to SEQ ID NO: 199762
  derived and/or modified sequence opt5 from neuraminidase__InfluenzaA__ACZ16313

SEQ ID NO: 200666 - RNA, 1410 nt, Artificial Sequence; identical to SEQ ID NO: 199762
  derived and/or modified sequence opt5 from neuraminidase__InfluenzaA__ACZ16323

SEQ ID NO: 200667 - RNA, 1410 nt, Artificial Sequence; identical to SEQ ID NO: 199762
  derived and/or modified sequence opt5 from neuraminidase__InfluenzaA__ACZ16333

SEQ ID NO: 200668 - RNA, 1410 nt, Artificial Sequence; identical to SEQ ID NO: 200470
  derived and/or modified sequence opt5 from neuraminidase__InfluenzaA__ACZ16343

SEQ ID NO: 200669 - RNA, 1410 nt, Artificial Sequence; identical to SEQ ID NO: 199762
  derived and/or modified sequence opt5 from neuraminidase__InfluenzaA__ACZ16353

SEQ ID NO: 200670 - RNA, 1410 nt, Artificial Sequence; identical to SEQ ID NO: 199762
  derived and/or modified sequence opt5 from neuraminidase__InfluenzaA__ACZ16363

SEQ ID NO: 200671 - RNA, 1410 nt, Artificial Sequence; identical to SEQ ID NO: 199752
  derived and/or modified sequence opt5 from neuraminidase__InfluenzaA__ACZ16373

SEQ ID NO: 200672 - RNA, 1410 nt, Artificial Sequence; identical to SEQ ID NO: 199762
  derived and/or modified sequence opt5 from neuraminidase__InfluenzaA__ACZ16383

SEQ ID NO: 200673 - RNA, 1410 nt, Artificial Sequence; identical to SEQ ID NO: 199762
  derived and/or modified sequence opt5 from neuraminidase__InfluenzaA__ACZ16393

SEQ ID NO: 200674 - RNA, 1410 nt, Artificial Sequence; identical to SEQ ID NO: 199762
  derived and/or modified sequence opt5 from neuraminidase__InfluenzaA__ACZ16403

SEQ ID NO: 200675 - RNA, 1410 nt, Artificial Sequence; identical to SEQ ID NO: 199762
  derived and/or modified sequence opt5 from neuraminidase__InfluenzaA__ACZ16423

SEQ ID NO: 200676 - RNA, 1410 nt, Artificial Sequence; identical to SEQ ID NO: 199762
  derived and/or modified sequence opt5 from neuraminidase__InfluenzaA__ACZ16433

SEQ ID NO: 200677 - RNA, 1410 nt, Artificial Sequence; identical to SEQ ID NO: 199762
  derived and/or modified sequence opt5 from neuraminidase__InfluenzaA__ACZ16443

SEQ ID NO: 200678 - RNA, 1410 nt, Artificial Sequence; identical to SEQ ID NO: 199762
  derived and/or modified sequence opt5 from neuraminidase__InfluenzaA__ACZ16453

SEQ ID NO: 200679 - RNA, 1410 nt, Artificial Sequence; identical to SEQ ID NO: 200470
  derived and/or modified sequence opt5 from neuraminidase__InfluenzaA__ACZ16463

SEQ ID NO: 200680 - RNA, 1410 nt, Artificial Sequence; identical to SEQ ID NO: 199762
  derived and/or modified sequence opt5 from neuraminidase__InfluenzaA__ACZ16483

SEQ ID NO: 200681 - RNA, 1410 nt, Artificial Sequence; identical to SEQ ID NO: 199762
  derived and/or modified sequence opt5 from neuraminidase__InfluenzaA__ACZ16493

SEQ ID NO: 200682 - RNA, 1410 nt, Artificial Sequence
  derived and/or modified sequence opt5 from neuraminidase__InfluenzaA__ACZ16503
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagauggaugcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200683 - RNA, 1410 nt, Artificial Sequence; identical to SEQ ID NO: 200470
  derived and/or modified sequence opt5 from neuraminidase__InfluenzaA__ACZ16513

SEQ ID NO: 200684 - RNA, 1410 nt, Artificial Sequence; identical to SEQ ID NO: 199762
  derived and/or modified sequence opt5 from neuraminidase__InfluenzaA__ACZ16523

SEQ ID NO: 200685 - RNA, 1410 nt, Artificial Sequence; identical to SEQ ID NO: 199762
  derived and/or modified sequence opt5 from neuraminidase__InfluenzaA__ACZ16533

SEQ ID NO: 200686 - RNA, 1410 nt, Artificial Sequence; identical to SEQ ID NO: 199752
  derived and/or modified sequence opt5 from neuraminidase__InfluenzaA__ACZ16543

SEQ ID NO: 200687 - RNA, 1410 nt, Artificial Sequence; identical to SEQ ID NO: 199762
  derived and/or modified sequence opt5 from neuraminidase__InfluenzaA__ACZ16553

SEQ ID NO: 200688 - RNA, 1410 nt, Artificial Sequence; identical to SEQ ID NO: 199762
  derived and/or modified sequence opt5 from neuraminidase__InfluenzaA__ACZ16586

SEQ ID NO: 200689 - RNA, 1410 nt, Artificial Sequence; identical to SEQ ID NO: 199762
  derived and/or modified sequence opt5 from neuraminidase__InfluenzaA__ACZ16596

SEQ ID NO: 200690 - RNA, 1410 nt, Artificial Sequence; identical to SEQ ID NO: 199762
  derived and/or modified sequence opt5 from neuraminidase__InfluenzaA__ACZ16606

SEQ ID NO: 200691 - RNA, 1410 nt, Artificial Sequence; identical to SEQ ID NO: 199762
  derived and/or modified sequence opt5 from neuraminidase__InfluenzaA__ACZ16633

SEQ ID NO: 200692 - RNA, 1410 nt, Artificial Sequence
  derived and/or modified sequence opt5 from neuraminidase__InfluenzaA__ACZ16643
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugagauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 200693 - RNA, 1410 nt, Artificial Sequence; identical to SEQ ID NO: 199762
  derived and/or modified sequence opt5 from neuraminidase__InfluenzaA__ACZ16653

SEQ ID NO: 200694 - RNA, 1410 nt, Artificial Sequence; identical to SEQ ID NO: 199762
  derived and/or modified sequence opt5 from neuraminidase__InfluenzaA__ACZ16663

SEQ ID NO: 200695 - RNA, 1410 nt, Artificial Sequence; identical to SEQ ID NO: 199762
  derived and/or modified sequence opt5 from neuraminidase__InfluenzaA__ACZ16673

SEQ ID NO: 200696 - RNA, 1410 nt, Artificial Sequence; identical to SEQ ID NO: 199762
  derived and/or modified sequence opt5 from neuraminidase__InfluenzaA__ACZ16683

SEQ ID NO: 200697 - RNA, 1410 nt, Artificial Sequence; identical to SEQ ID NO: 199762
  derived and/or modified sequence opt5 from neuraminidase__InfluenzaA__ACZ16693

SEQ ID NO: 200698 - RNA, 1410 nt, Artificial Sequence; identical to SEQ ID NO: 199762
  derived and/or modified sequence opt5 from neuraminidase__InfluenzaA__ACZ16703

SEQ ID NO: 200699 - RNA, 1410 nt, Artificial Sequence; identical to SEQ ID NO: 199762
  derived and/or modified sequence opt5 from neuraminidase__InfluenzaA__ACZ16713

SEQ ID NO: 200700 - RNA, 1410 nt, Artificial Sequence; identical to SEQ ID NO: 199762
  derived and/or modified sequence opt5 from neuraminidase__InfluenzaA__ACZ16723

SEQ ID NO: 200701 - RNA, 1410 nt, Artificial Sequence; identical to SEQ ID NO: 199762
  derived and/or modified sequence opt5 from neuraminidase__InfluenzaA__ACZ16733

SEQ ID NO: 200702 - RNA, 1410 nt, Artificial Sequence; identical to SEQ ID NO: 199762
  derived and/or modified sequence opt5 from neuraminidase__InfluenzaA__ACZ16743

SEQ ID NO: 200703 - RNA, 1410 nt, Artificial Sequence; identical to SEQ ID NO: 199762
  derived and/or modified sequence opt5 from neuraminidase__InfluenzaA__ACZ16753

SEQ ID NO: 200704 - RNA, 1410 nt, Artificial Sequence; identical to SEQ ID NO: 199762
  derived and/or modified sequence opt5 from neuraminidase__InfluenzaA__ACZ16763

SEQ ID NO: 200705 - RNA, 1410 nt, Artificial Sequence; identical to SEQ ID NO: 199752
  derived and/or modified sequence opt5 from neuraminidase__InfluenzaA__ACZ16773

SEQ ID NO: 200706 - RNA, 1410 nt, Artificial Sequence; identical to SEQ ID NO: 199762
  derived and/or modified sequence opt5 from neuraminidase__InfluenzaA__ACZ16783

SEQ ID NO: 200707 - RNA, 1410 nt, Artificial Sequence; identical to SEQ ID NO: 199762
  derived and/or modified sequence opt5 from neuraminidase__InfluenzaA__ACZ16793

SEQ ID NO: 200708 - RNA, 1410 nt, Artificial Sequence; identical to SEQ ID NO: 199762
  derived and/or modified sequence opt5 from neuraminidase__InfluenzaA__ACZ16803

SEQ ID NO: 200709 - RNA, 1410 nt, Artificial Sequence; identical to SEQ ID NO: 199762
  derived and/or modified sequence opt5 from neuraminidase__InfluenzaA__ACZ16813

SEQ ID NO: 200710 - RNA, 1410 nt, Artificial Sequence; identical to SEQ ID NO: 199752
  derived and/or modified sequence opt5 from neuraminidase__InfluenzaA__ACZ16823

SEQ ID NO: 200711 - RNA, 1410 nt, Artificial Sequence; identical to SEQ ID NO: 199762
  derived and/or modified sequence opt5 from neuraminidase__InfluenzaA__ACZ16833

SEQ ID NO: 200712 - RNA, 1410 nt, Artificial Sequence; identical to SEQ ID NO: 199762
  derived and/or modified sequence opt5 from neuraminidase__InfluenzaA__ACZ16843

SEQ ID NO: 200713 - RNA, 1410 nt, Artificial Sequence; identical to SEQ ID NO: 200682
  derived and/or modified sequence opt5 from neuraminidase__InfluenzaA__ACZ16853

SEQ ID NO: 200714 - RNA, 1410 nt, Artificial Sequence; identical to SEQ ID NO: 199762
  derived and/or modified sequence opt5 from neuraminidase__InfluenzaA__ACZ16863

SEQ ID NO: 200715 - RNA, 1410 nt, Artificial Sequence; identical to SEQ ID NO: 199762
  derived and/or modified sequence opt5 from neuraminidase__InfluenzaA__ACZ16873

SEQ ID NO: 200716 - RNA, 1410 nt, Artificial Sequence; identical to SEQ ID NO: 199762
  derived and/or modified sequence opt5 from neuraminidase__InfluenzaA__ACZ16883

SEQ ID NO: 200717 - RNA, 1410 nt, Artificial Sequence; identical to SEQ ID NO: 199762
  derived and/or modified sequence opt5 from neuraminidase__InfluenzaA__ACZ16893

SEQ ID NO: 200718 - RNA, 1410 nt, Artificial Sequence; identical to SEQ ID NO: 199762
  derived and/or modified sequence opt5 from neuraminidase__InfluenzaA__ACZ16903

SEQ ID NO: 200719 - RNA, 1410 nt, Artificial Sequence; identical to SEQ ID NO: 199762
  derived and/or modified sequence opt5 from neuraminidase__InfluenzaA__ACZ16913

SEQ ID NO: 200720 - RNA, 1410 nt, Artificial Sequence; identical to SEQ ID NO: 199762
  derived and/or modified sequence opt5 from neuraminidase__InfluenzaA__ACZ16923

SEQ ID NO: 200721 - RNA, 1410 nt, Artificial Sequence; identical to SEQ ID NO: 199762
  derived and/or modified sequence opt5 from neuraminidase__InfluenzaA__ACZ16933

SEQ ID NO: 200722 - RNA, 1410 nt, Artificial Sequence; identical to SEQ ID NO: 199762
  derived and/or modified sequence opt5 from neuraminidase__InfluenzaA__ACZ16943

SEQ ID NO: 200723 - RNA, 1410 nt, Artificial Sequence; identical to SEQ ID NO: 199752
  derived and/or modified sequence opt5 from neuraminidase__InfluenzaA__ACZ16953

SEQ ID NO: 200724 - RNA, 1410 nt, Artificial Sequence; identical to SEQ ID NO: 199762
  derived and/or modified sequence opt5 from neuraminidase__InfluenzaA__ACZ16963

SEQ ID NO: 200725 - RNA, 1410 nt, Artificial Sequence; identical to SEQ ID NO: 199762
  derived and/or modified sequence opt5 from neuraminidase__InfluenzaA__ACZ16973

SEQ ID NO: 200726 - RNA, 1410 nt, Artificial Sequence; identical to SEQ ID NO: 199762
  derived and/or modified sequence opt5 from neuraminidase__InfluenzaA__ACZ16983

SEQ ID NO: 200727 - RNA, 1410 nt, Artificial Sequence; identical to SEQ ID NO: 199762
  derived and/or modified sequence opt5 from neuraminidase__InfluenzaA__ACZ16993

SEQ ID NO: 200728 - RNA, 1410 nt, Artificial Sequence; identical to SEQ ID NO: 199762
  derived and/or modified sequence opt5 from neuraminidase__InfluenzaA__ACZ17003

SEQ ID NO: 200729 - RNA, 1410 nt, Artificial Sequence; identical to SEQ ID NO: 199762
  derived and/or modified sequence opt5 from neuraminidase__InfluenzaA__ACZ17023

SEQ ID NO: 200730 - RNA, 1410 nt, Artificial Sequence; identical to SEQ ID NO: 199762
  derived and/or modified sequence opt5 from neuraminidase__InfluenzaA__ACZ17043

SEQ ID NO: 200731 - RNA, 1410 nt, Artificial Sequence; identical to SEQ ID NO: 199762
  derived and/or modified sequence opt5 from neuraminidase__InfluenzaA__ACZ17053

SEQ ID NO: 200732 - RNA, 1410 nt, Artificial Sequence
  derived and/or modified sequence opt5 from neuraminidase__InfluenzaA__ACZ17063
augaaccccaaucagaagaucauuaccaucggcagcgugugcaugacaauugggauggccaaccugauccuccaaauuggaaauaucaucuccauuuggaucucucacagcauucagcugggcgaccagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaauggcaccauuaaagacagaagcccuuaucggacgcucaugucuugucccaucggggaggugccuucccccuacaacagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200733 - RNA, 1410 nt, Artificial Sequence; identical to SEQ ID NO: 199762
  derived and/or modified sequence opt5 from neuraminidase__InfluenzaA__ACZ17073

SEQ ID NO: 200734 - RNA, 1410 nt, Artificial Sequence; identical to SEQ ID NO: 200470
  derived and/or modified sequence opt5 from neuraminidase__InfluenzaA__ACZ17083

SEQ ID NO: 200735 - RNA, 1410 nt, Artificial Sequence
  derived and/or modified sequence opt5 from neuraminidase__InfluenzaA__ACZ17093
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucccuuugaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagagaacacgaucuggaccuccgggagcucuauuuccuucuguggaguuaauagcgacacagugggcuggucuuggcccgauggggcugagcucccuuuuaccaucgacaaguga

SEQ ID NO: 200736 - RNA, 1410 nt, Artificial Sequence
  derived and/or modified sequence opt5 from neuraminidase__InfluenzaA__ACZ17113
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 200737 - RNA, 1410 nt, Artificial Sequence; identical to SEQ ID NO: 199762
  derived and/or modified sequence opt5 from neuraminidase__InfluenzaA__ACZ17123

SEQ ID NO: 200738 - RNA, 1410 nt, Artificial Sequence; identical to SEQ ID NO: 199762
  derived and/or modified sequence opt5 from neuraminidase__InfluenzaA__ACZ17133

SEQ ID NO: 200739 - RNA, 1410 nt, Artificial Sequence
  derived and/or modified sequence opt5 from neuraminidase__InfluenzaA__ACZ17163
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucgcaaccuggaauaucagaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgccccaaagagaacacgaucuggaccuccgggagcucuauuuccuuuuguggaguuaauagcgacacagugggcuggucuuggcccgauggggcugagcugccuuucaccaucgacaaguga

SEQ ID NO: 200740 - RNA, 1410 nt, Artificial Sequence; identical to SEQ ID NO: 200739
  derived and/or modified sequence opt5 from neuraminidase__InfluenzaA__ACZ17173

SEQ ID NO: 200741 - RNA, 1410 nt, Artificial Sequence; identical to SEQ ID NO: 200739
  derived and/or modified sequence opt5 from neuraminidase__InfluenzaA__ACZ17183

SEQ ID NO: 200742 - RNA, 1410 nt, Artificial Sequence; identical to SEQ ID NO: 200739
  derived and/or modified sequence opt5 from neuraminidase__InfluenzaA__ACZ17193

SEQ ID NO: 200743 - RNA, 1410 nt, Artificial Sequence; identical to SEQ ID NO: 200739
  derived and/or modified sequence opt5 from neuraminidase__InfluenzaA__ACZ17203

SEQ ID NO: 200744 - RNA, 1410 nt, Artificial Sequence; identical to SEQ ID NO: 199762
  derived and/or modified sequence opt5 from neuraminidase__InfluenzaA__ACZ17213

SEQ ID NO: 200745 - RNA, 1410 nt, Artificial Sequence; identical to SEQ ID NO: 199762
  derived and/or modified sequence opt5 from neuraminidase__InfluenzaA__ACZ17223

SEQ ID NO: 200746 - RNA, 1410 nt, Artificial Sequence; identical to SEQ ID NO: 199762
  derived and/or modified sequence opt5 from neuraminidase__InfluenzaA__ACZ17233

SEQ ID NO: 200747 - RNA, 1410 nt, Artificial Sequence; identical to SEQ ID NO: 199762
  derived and/or modified sequence opt5 from neuraminidase__InfluenzaA__ACZ17243

SEQ ID NO: 200748 - RNA, 1410 nt, Artificial Sequence; identical to SEQ ID NO: 199762
  derived and/or modified sequence opt5 from neuraminidase__InfluenzaA__ACZ17263

SEQ ID NO: 200749 - RNA, 1410 nt, Artificial Sequence
  derived and/or modified sequence opt5 from neuraminidase__InfluenzaA__ACZ17273
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggauucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuuuaccgugaugacggauggaccgagcgacggccaggccucuuacaaaaucuuccgcauugaaaagggcaaaaucgucaagagcguugagaugaaugcucccaacuaucauuacgaagagugcuccuguuacccugauucuagcgagaucacaugcgugugcagagacaauuggcacggguccaaccggcccugggugagcuuuaaucagaaccuggaauaucagauuggauacaucuguucuggcauuuucggggauaauccucgccccaacgacaaaaccggauccugcggcccgguccuuagcaauggggccaacggagugaagggcuuuucuuucaaguauggcaacgggguuuggaucggaagaacaaaauccauuagcucccggaauggcuuugagaugaucugggauccuaacggguggaccggaaccgacaauaacuucucuauuaagcaagacaucgugggcaucaaugaauggagcggguacuccggcucuuucguccagcaucccgagcugacaggacucgauuguauucgcccuugcuuuuggguggaacugaucagaggccggcccaaagagaacacgauuuggaccagcggguccagcaucucuuucuguggaguuaauuccgacacagugggcuggagcuggcccgauggggcugagcuuccuuuuaccauugacaaguga

SEQ ID NO: 200750 - RNA, 1410 nt, Artificial Sequence; identical to SEQ ID NO: 199762
  derived and/or modified sequence opt5 from neuraminidase__InfluenzaA__ACZ17283

SEQ ID NO: 200751 - RNA, 1410 nt, Artificial Sequence; identical to SEQ ID NO: 199792
  derived and/or modified sequence opt5 from neuraminidase__InfluenzaA__ACZ17293

SEQ ID NO: 200752 - RNA, 1410 nt, Artificial Sequence; identical to SEQ ID NO: 199792
  derived and/or modified sequence opt5 from neuraminidase__InfluenzaA__ACZ17303

SEQ ID NO: 200753 - RNA, 1410 nt, Artificial Sequence; identical to SEQ ID NO: 199792
  derived and/or modified sequence opt5 from neuraminidase__InfluenzaA__ACZ17313

SEQ ID NO: 200754 - RNA, 1410 nt, Artificial Sequence; identical to SEQ ID NO: 199762
  derived and/or modified sequence opt5 from neuraminidase__InfluenzaA__ACZ17401

SEQ ID NO: 200755 - RNA, 1410 nt, Artificial Sequence; identical to SEQ ID NO: 199762
  derived and/or modified sequence opt5 from neuraminidase__InfluenzaA__ACZ17411

SEQ ID NO: 200756 - RNA, 1410 nt, Artificial Sequence; identical to SEQ ID NO: 199762
  derived and/or modified sequence opt5 from neuraminidase__InfluenzaA__ACZ17421

SEQ ID NO: 200757 - RNA, 1410 nt, Artificial Sequence
  derived and/or modified sequence opt5 from neuraminidase__InfluenzaA__ACZ17431
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaacgcucccaauuaucauuacgaagagugcuccuguuacccugacucuagcgagaucacaugcgugugcagagauaacuggcacggguccaaucggcccugggucagcuucaaccagaaucuggaauaucagauuggauacaucuguucuggcauuuuuggggacaacccucgccccaaugauaaaaccggauccugcggcccggugagcucuaacggggccaacggaguuaagggcuucuccuuuaaguauggcaaugggguguggaucggaagaacaaaaagcauuaacucccggaauggcuucgagaugaucugggacccuaacggguggaccggaaccgauaauaacuuuucuauuaagcaagacaucgucggcaucaaugaauggagcggguacuccggcucuuucgugcagcaucccgagcuuacaggacuggacuguauucgcccuugcuucuggguugaacucaucagaggccggcccaaagagaacacgauuuggaccagcggguccagcaucucuuuuuguggagucaauuccgauacagugggcuggagcuggcccgacggggcugagcugccuuucaccauugauaaguga

SEQ ID NO: 200758 - RNA, 1410 nt, Artificial Sequence; identical to SEQ ID NO: 200757
  derived and/or modified sequence opt5 from neuraminidase__InfluenzaA__ACZ17441

SEQ ID NO: 200759 - RNA, 1410 nt, Artificial Sequence; identical to SEQ ID NO: 199752
  derived and/or modified sequence opt5 from neuraminidase__InfluenzaA__ACZ17451

SEQ ID NO: 200760 - RNA, 1410 nt, Artificial Sequence; identical to SEQ ID NO: 199762
  derived and/or modified sequence opt5 from neuraminidase__InfluenzaA__ACZ17461

SEQ ID NO: 200761 - RNA, 1410 nt, Artificial Sequence; identical to SEQ ID NO: 199762
  derived and/or modified sequence opt5 from neuraminidase__InfluenzaA__ACZ17471

SEQ ID NO: 200762 - RNA, 1410 nt, Artificial Sequence; identical to SEQ ID NO: 199792
  derived and/or modified sequence opt5 from neuraminidase__InfluenzaA__ACZ17481

SEQ ID NO: 200763 - RNA, 1410 nt, Artificial Sequence; identical to SEQ ID NO: 199762
  derived and/or modified sequence opt5 from neuraminidase__InfluenzaA__ACZ17491

SEQ ID NO: 200764 - RNA, 1410 nt, Artificial Sequence; identical to SEQ ID NO: 200228
  derived and/or modified sequence opt5 from neuraminidase__InfluenzaA__ACZ27803

SEQ ID NO: 200765 - RNA, 1410 nt, Artificial Sequence; identical to SEQ ID NO: 199752
  derived and/or modified sequence opt5 from neuraminidase__InfluenzaA__ACZ27813

SEQ ID NO: 200766 - RNA, 1410 nt, Artificial Sequence; identical to SEQ ID NO: 199762
  derived and/or modified sequence opt5 from neuraminidase__InfluenzaA__ACZ27823

SEQ ID NO: 200767 - RNA, 1410 nt, Artificial Sequence; identical to SEQ ID NO: 199752
  derived and/or modified sequence opt5 from neuraminidase__InfluenzaA__ACZ27833

SEQ ID NO: 200768 - RNA, 1410 nt, Artificial Sequence; identical to SEQ ID NO: 199762
  derived and/or modified sequence opt5 from neuraminidase__InfluenzaA__ACZ45022

SEQ ID NO: 200769 - RNA, 1410 nt, Artificial Sequence
  derived and/or modified sequence opt5 from neuraminidase__InfluenzaA__ACZ53958
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcaagaucguccacaccagcucccuuucugggagcgcccaacacguugaggaaugcuccuguuauccucgcuaccccggagugagaugcgugugucgggacaacuggaagggcagcaaucgcccuauugucgauaucaacgugaaagacuacucuauuguuuccagcuaugugugcucuggccuggucggggacacacccagaaagaaugauagcuccucuagcucccauugucucgacccgaacaaugaggaaggaggccacggggugaaaggaugggcuuucgaugacggcaacgauguuuggauggggcggaccaucagcgagaagcugcgcucuggauacgagacguuuaaagugauugaaggcugguccaagccuaauagcaaacugcagaucaacagacaggucaucguggaccggggcaaucgcucuggguauuccggaauuuucagcgucgagggcaaguccugcaucaacagauguuuuuacguggaacucauucgggggagaaagcaggagacagaaguucuguggaccucuaauagcaucguggucuucugcggaaccuccggcacauaugggaccggcucuugucccgauggaagcgugcuuaaccugaugccuauuuga

SEQ ID NO: 200770 - RNA, 1410 nt, Artificial Sequence
  derived and/or modified sequence opt5 from neuraminidase__InfluenzaA__ACZ53969
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccacaaucauugagagaaauaucaccgaaauuguguaucucacaaacaccacgaucgagaaggaaauuuguccuaaacuggccgaguaccggaauuggagcaagccccagugcaacaucaccggguucgcgccuuuuuccaaagacaauucuauucgccuuagcgcuggaggcgauaucugggucacaagagagcccuauguguccugugacccugauaagugcuaccaauucgcccuggggcagggaaccacacucaacaauggccauucuaacgacaccguucacgaucggacgccguaucgcacacugcugaugaaugaacucggggugcccuuucaucugggaaccaagcaggucuguaucgccuggagcuccagcucuugccacgacggcaaagccuggcuucauguguguguuacaggcgaugacgagaacgcuaccgcuuccuucauuuacaaugggagacugguggauagcaucggaucuugguccaagaaaauucuccggacccaggaaagcgagugcgucuguaucaacggcacaugcacgguggugaugaccgacgggucugccuccggaaaggcggauacaaaaauucuguuuaucgaggaaggcgagaucguccacaccagcccucuuuccgggucugcccaacacguugaagagugcagcuguuauccccgcuacccuggagugagaugcgugugucgggacaacuggaagggcuccaaucgccccauugucgauaucaacgugaaggacuacagcauuguuucuuccuaugugugcagcggccuggucggggacacaccgcggaaaaaugauucuagcuccucuagccauugucucgacccuaacaaugaagagggaggccacggggugaagggaugggcuuucgaugacggcaacgauguuuggauggggagaaccaucuccgagaaaagccgcucuggauacgaaacguuuaaggugauugagggcugguccaaacccaauagcaagcugcagaucaacagacaggucaucguggaccggggcaaucgcucuggguauuccggaauuuucagcgucgaaggcaaauccugcaucaacagauguuuuuacguggagcugauucgggggagaaagcaggaaacagagguucucuggaccucuaauagcaucguggucuucugcggaaccuccggcacauaugggaccggcucuuggccugauggaagcgugcugaaccuuaugcccauuuga

SEQ ID NO: 200771 - RNA, 1410 nt, Artificial Sequence
  derived and/or modified sequence opt5 from neuraminidase__InfluenzaA__ACZ53980
augaaccccaaucagaacaagcugccuaucggcagcgugucccucaccauugccacaaucugcuuccugaugcaaauugcuauccuuaaaacgaccgucacacugcacuuuaagcaguacgaguguaauucuccgcccaacaaucagguuaugcucugcgaaccuaccauuaucgagagaaaccugacaaaaaucguguaucuuaccaauacaaccauuaagaaagaaaucugucccaagcagccuaaguaccggaacuggagcaaacccaagugcaaaauuacggagcuggccccuuucuccaaggacaauucuauccgccucagcgcugggggagauauuugggugaccagagaaccguaugucuccugugaccccgauaaaugcuaccaauuugcgcugggccaggggacaacccugaacaauggacauucuaacgacacagugcacgaucggaccccuuaucgcacgcuccugaugaaugagcuuggcguucccuuccaucuggggacaaaacagguguguaucgccuggagcuccagcucuugccacgacggaaaggccuggcuccaugucuguauuaccggcgaugacaaaaacgcuacagccuccuuuaucuacaauggcagacugguggauagcaucguuucuugguccaaggagauucuucggacccaggaaagcgagugcguguguaucaacgggaccugcacagucgugaugacggacggaucugcuuccggcaaagccgauaccaagauucuguucaucgaagaggggaaaauugugcacaucagcccucucuccggaucugcgcaacacgucgaggaaugcagcuguuauccccgcuacccgggcguuagaugcaucugucgggacaacuggaagggguccaaucgcccugugguggauauuaacauggaggacuacagcaucgacucuuccuaugucugcagcggacuggugggcgauacacccagaaagaaugacucuagcuccucuagccauugucuggauccuaacaaugaagagggcgggcacggaguuaagggcugggccuuugacgaugggaacgacguguggaugggacggaccauuuccgaaaagcuccgcagcggcuacgagacauucaaagucaucgggggauggucuaagcccaauuccaaacugcagauuaacagacaggugaucguugaucggggcaaucgcagcggcuauucugggaucuuuuccguggagggaaagagcugcauuaacagauguuucuacgucgaacuuauccggggcagaaaacaggagaccgaagugcuguggacguccaauucuauugucguguuuugcgggacaagcggaaccuauggcaccggguccuggcccgacggcucuguucucaaccugaugccuaucuga

SEQ ID NO: 200772 - RNA, 1410 nt, Artificial Sequence; identical to SEQ ID NO: 199762
  derived and/or modified sequence opt5 from neuraminidase__InfluenzaA__ACZ56082

SEQ ID NO: 200773 - RNA, 1410 nt, Artificial Sequence; identical to SEQ ID NO: 200345
  derived and/or modified sequence opt5 from neuraminidase__InfluenzaA__ACZ57183

SEQ ID NO: 200774 - RNA, 1413 nt, Artificial Sequence
  derived and/or modified sequence opt5 from neuraminidase__InfluenzaA__ACZ81542
augaaccccaaucagaaggugaucaccauuggcagcaucuccauugccaucgggauuaucucucugaugcuccaaaucggaaacauuaucagcauuugggcuucccacucuauccagacaggcagccagaauaacacggggauuugcaaucagagaaucauuaccuacgagaacuccacaugggucaaucauaccuauguuaacaucaauaacacaaaugugguggccggagaagacaaaaccucugucacacuggcgggcaacagcucccuuuguagcaucucugggugggcuauuuacaccaaggauaauuccauccggauuggaagcaaaggcgacguguucguuauccgcgagccuuuuauuucuugcucccaccuggaauguagaacguucuuucucacccaaggcgcccugcuuaacgauaagcauagcaaugggacagugaaagaccggucuccguaucgcgcccugauguccugcccccucggagaggcuccuagccccuacaacuccaaguucgaaucugucgccuggagcgcuuccgccugucacgauggcaugggguggcugaccaucggaaucagcggcccugacaacggggcgguggccguucugaaguauaauggaauuaucacaggcaccauuaaaucuuggaagaaacagauccucagaacgcaggaguccgagugcguguguaugaacggcagcugcuuuacaauuaugaccgaugggcccucuaauaaggcugccagcuacaaaaucuucaagaucgaaaagggaaaagucacaaaguccauugagcugaacgcuccuaauuuuuauuacgaagaguguucuugcuacccggacaccggcaucgugaugugugugugccgggauaacuggcaugggagcaaucgccccugggucuccuucaaccagaaucuugacuaucaaauuggauacaucugcagcggcguuuuuggggauaacccuagacccgaggacggagaaggcucuuguaauccugugaccguggauggcgccaacggggucaaaggauucuccuauaaguacggcaaugggguguggauuggacggacaaaaagcaaccgccugagaaagggcuuugagaugaucugggaccccaauggguggacgaacaccgacucugauuucuccguuaaacaggacguggucgcgauuacagauuggagcggcuauuccggaucuuuugugcagcacccggaacucaccggccuggacugcauccggccuuguuucuggguugagcuugugcgcgggcugcccagagaaaacacaaccaucuggacgagcggauccucuauuagcuucugcggcgucaauuccgauacagccaacuggagcuggccugacggggcugagcuccccuuuaccaucgauaaguga

SEQ ID NO: 200775 - RNA, 1413 nt, Artificial Sequence
  derived and/or modified sequence opt5 from neuraminidase__InfluenzaA__ACZ81543
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacaauacaugggugaaccauaccuaugucaauaucaacaauacaaacguuguggccggagaagacaaaaccuccgugacacuggcgggcaauucuagccuuuguuccauuagcgggugggcuaucuacaccaaggauaacucuauucggaucggauccaaaggcgacgucuucgugauucgcgagccuuuuaucagcugcucucaccuggaauguagaacguucuuucucacccaaggcgcccugcuuaaugauaagcauuccaacgggacaguuaaagaccggagcccguaucgcgcccugaugucuugcccccucggagaggcuccuucccccuacaacagcaaguucgaauccguggccuggucugcuagcgccugucacgauggcaugggguggcugaccaucggaauuuccggcccugacaauggggcggucgccgugcugaaguauaacggaaucauuacaggcaccaucaaaagcuggaaggagcagauucucagaacgcaggagucugaaugcguuuguaugaauggcuccugcuuuacaaucaugaccgaugggcccagcaacaaagcugccucuuacaagaucuucaaaauugagaagggaaaggugacaaaaagcaucgaacugaaugcuccuaacuuuuauuacgaggaguguuccugcuacccggacaccggcauugucaugugugugugccgggauaauuggcaugggucuaaccgccccugggugagcuucaaucagaaccuugacuaucaaaccggauacaucugcuccggcgucuuuggggauaauccuagacccgaagacggagagggcagcuguaacccuguuacaguggauggcgccaauggggugaagggauucucuuauaaauacggcaacggggucuggauuggacggacgaaguccaaucgccugagaaaaggcuuugaaaugaucugggaccccaacggguggaccaacacagacagcgauuucucugugaagcaggacguuguggcgauuaccgauugguccggcuauagcggauccuuuguccagcacccggagcucacaggccuggacugcauccggccuuguuucuggguggaacuuguucgcgggcugcccagagagaauaccacgaucuggacaucuggaagcuccauuucuuucugcggcgugaacagcgauaccgccaauugguccuggccugacggggcugagcuccccuuuaccaucgauaaauga

SEQ ID NO: 200776 - RNA, 1410 nt, Artificial Sequence
  derived and/or modified sequence opt5 from neuraminidase__InfluenzaA__ACZ81546
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccgggucugccccuuucagcaaagauaacuccauccgccugucugcgggaggcgacaucugggugacaagagagcccuaugucagcugcgauccugacaaguguuaccaauuugcucuugggcagggaaccacacugaauaacgugcauuccaauaacaccguucacgaucggacgccguaucgcacacuccugaugaaugaacugggcgugcccuuccaucucgggaccaagcaggucugcauugccugguccucuuccagcugucacgacggaaaagccuggcugcaugugugcaucacaggcgaugacaagaacgcuaccgccucuuuuauuuacaauggcagacuuguugauuccguggucagcuggucuaaagagauccugcggacccaggaauccgagugugugugcauuaacgggacauguacgguggucaugaccgacggaagcgcuuccggcaaggccgauacaaaaauccucuucaucgaggaagggaagauuguucacaccucuacacugagcggauccgcgcaacacguggaggaaugcagcugcuauccucgcuaccccggcgugagaugugucugccgggacaacuggaaggggucuaaucgcccuaucguggauauuaacaucaaagaccauuccauuguuagcucuuacguguguagcggacuugucggcgacacccccagaaagaaugauuccucuagcuccagccacugccuggacccgaacaaugaggaaggcgggcauggagugaaaggcugggccuuugaugacgggaacgauguuuggaugggacggacgaucucugagaagucccgccucggcuaugagacauucaaagugaucgaaggguggagcaauccuaagucuaaacugcagauuaacagacaggucaucguggaccggggaaaucgcuccggcuacagcggcauuuuuagcgucgaggggaagucuuguaucaacagaugcuucuauguggaacugauucggggaagaaaggaggaaaccgagguucucuggaccagcaauuccaucguggucuuuuguggcacaucugggaccuacggaacaggcagcuggcccgauggggcugacauuaaccugaugccuaucuga

SEQ ID NO: 200777 - RNA, 1410 nt, Artificial Sequence
  derived and/or modified sequence opt5 from neuraminidase__InfluenzaA__ACZ81547
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaccaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcacaauuagcgagaagucuagacucggcuaugagaccuuuaaagugaucgaagggugguccaauccuaagagcaaacugcagaucaaccggcaggucauuguggacaagggaaaucgcucuggcuacuccggcaucuucagcgucgaggggaaguccuguauuaacagaugcuuuuauguggaacugauccggggaagaaaagaggaaaccgagguucucuggacaucuaauagcauuguggucuucuguggcaccuccgggacauacggaacgggcucuuggcccgauggggcugacaucaaccugaugccuauuuga

SEQ ID NO: 200778 - RNA, 1410 nt, Artificial Sequence; identical to SEQ ID NO: 199762
  derived and/or modified sequence opt5 from neuraminidase__InfluenzaA__ACZ81634

SEQ ID NO: 200779 - RNA, 1410 nt, Artificial Sequence
  derived and/or modified sequence opt5 from neuraminidase__InfluenzaA__ACZ81644
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucauuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 200780 - RNA, 1410 nt, Artificial Sequence
  derived and/or modified sequence opt5 from neuraminidase__InfluenzaA__ACZ81653
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacugaacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 200781 - RNA, 1410 nt, Artificial Sequence; identical to SEQ ID NO: 199762
  derived and/or modified sequence opt5 from neuraminidase__InfluenzaA__ACZ95840

SEQ ID NO: 200782 - RNA, 1410 nt, Artificial Sequence; identical to SEQ ID NO: 199762
  derived and/or modified sequence opt5 from neuraminidase__InfluenzaA__ACZ95850

SEQ ID NO: 200783 - RNA, 1410 nt, Artificial Sequence; identical to SEQ ID NO: 199762
  derived and/or modified sequence opt5 from neuraminidase__InfluenzaA__ACZ95860

SEQ ID NO: 200784 - RNA, 1410 nt, Artificial Sequence; identical to SEQ ID NO: 199762
  derived and/or modified sequence opt5 from neuraminidase__InfluenzaA__ACZ95870

SEQ ID NO: 200785 - RNA, 1410 nt, Artificial Sequence; identical to SEQ ID NO: 199762
  derived and/or modified sequence opt5 from neuraminidase__InfluenzaA__ACZ95880

SEQ ID NO: 200786 - RNA, 1410 nt, Artificial Sequence; identical to SEQ ID NO: 199762
  derived and/or modified sequence opt5 from neuraminidase__InfluenzaA__ACZ95890

SEQ ID NO: 200787 - RNA, 1410 nt, Artificial Sequence; identical to SEQ ID NO: 199762
  derived and/or modified sequence opt5 from neuraminidase__InfluenzaA__ACZ95900

SEQ ID NO: 200788 - RNA, 1410 nt, Artificial Sequence; identical to SEQ ID NO: 199762
  derived and/or modified sequence opt5 from neuraminidase__InfluenzaA__ACZ95910

SEQ ID NO: 200789 - RNA, 1410 nt, Artificial Sequence; identical to SEQ ID NO: 199762
  derived and/or modified sequence opt5 from neuraminidase__InfluenzaA__ACZ95920

SEQ ID NO: 200790 - RNA, 1410 nt, Artificial Sequence; identical to SEQ ID NO: 200649
  derived and/or modified sequence opt5 from neuraminidase__InfluenzaA__ACZ95930

SEQ ID NO: 200791 - RNA, 1410 nt, Artificial Sequence; identical to SEQ ID NO: 199762
  derived and/or modified sequence opt5 from neuraminidase__InfluenzaA__ACZ95940

SEQ ID NO: 200792 - RNA, 1410 nt, Artificial Sequence; identical to SEQ ID NO: 200779
  derived and/or modified sequence opt5 from neuraminidase__InfluenzaA__ACZ95950

SEQ ID NO: 200793 - RNA, 1410 nt, Artificial Sequence; identical to SEQ ID NO: 199762
  derived and/or modified sequence opt5 from neuraminidase__InfluenzaA__ACZ95960

SEQ ID NO: 200794 - RNA, 1410 nt, Artificial Sequence; identical to SEQ ID NO: 200779
  derived and/or modified sequence opt5 from neuraminidase__InfluenzaA__ACZ95970

SEQ ID NO: 200795 - RNA, 1410 nt, Artificial Sequence; identical to SEQ ID NO: 199762
  derived and/or modified sequence opt5 from neuraminidase__InfluenzaA__ACZ95980

SEQ ID NO: 200796 - RNA, 1410 nt, Artificial Sequence; identical to SEQ ID NO: 199762
  derived and/or modified sequence opt5 from neuraminidase__InfluenzaA__ACZ95990

SEQ ID NO: 200797 - RNA, 1410 nt, Artificial Sequence; identical to SEQ ID NO: 199762
  derived and/or modified sequence opt5 from neuraminidase__InfluenzaA__ACZ96000

SEQ ID NO: 200798 - RNA, 1410 nt, Artificial Sequence; identical to SEQ ID NO: 199762
  derived and/or modified sequence opt5 from neuraminidase__InfluenzaA__ACZ96010

SEQ ID NO: 200799 - RNA, 1410 nt, Artificial Sequence
  derived and/or modified sequence opt5 from neuraminidase__InfluenzaA__ACZ96020
augaaccccaaucagaagaucauuaccaucggcagcgugugcaugacaauugggauggccaaccugauccuccaaauuggaaauaucauccugauuuggaucucccacucuauucagcuuggcaaccagaaucagacggagaccuguaaccaaagcgucaucacauacgaaaauaacaccuggguuaaucagacauaugugaacauuuccaauaccaacuucgcugccgggcagucuguggucagcgugaaacuggcgggaaauuccucucucugcccuguuagcggcugggcuaucuacuccaaggacaacagcgugagaauugggucuaaaggagaugucuuugugauccgggagccguucaucuccuguagcccccuggaaugccgcacauuuuuccuuacccagggcgcccugcucaaugacaagcauucuaacggcacgauuaaagauagauccccuuaucggacccugaugagcugucccaucggggagguuccuucucccuacaacucccgcuuugaaagcguggccugguccgcuucugccugccacgacggaauuaauuggcugacaaucggcauuagcgggccugauaacggagcugucgccgugcucaaguauaauggcaucaucaccgacacaauuaaguccuggagaaacaauauccugcggacccaagagagcgagugugcgugcgugaacgggucuuguuucacggucaugacagauggaccguccaauggccaggccagcuacaaaauuuuucgcaucgaaaagggcaaaauuguuaagucuguggagaugaacgcucccaauuaucauuacgaagagugcagcuguuacccugacuccucugagauuaccugcgugugcagagauaacuggcacgggagcaaucggcccugggucuccuucaaccagaaucuugaauaucagaucggauacaucuguagcggcaucuuuggggacaacccucgccccauugauaaaacaggaucuugcggcccgguguccagcaauggggccaacggaguuaagggcuucucuuuuaaguauggcaacgggguguggaucggaagaaccaaauccauuagcucccggaauggcuucgagaugaucugggacccuaacggguggaccggaacagauaauaacuuuucuauuaagcaagacaucgucggcaucaaugaauggagcggguacuccggcucuuucgugcagcaucccgagcugacgggacucgacuguauucgcccuugcuucuggguugaacugaucagaggccggcccaaagagaacaccauuuggacaagcggguccagcaucucuuuuuguggagucaauuccgauaccgugggcuggagcuggcccgacggggcugagcuuccuuucacaauugauaaguga

SEQ ID NO: 200800 - RNA, 1410 nt, Artificial Sequence; identical to SEQ ID NO: 199762
  derived and/or modified sequence opt5 from neuraminidase__InfluenzaA__ACZ96050

SEQ ID NO: 200801 - RNA, 1410 nt, Artificial Sequence; identical to SEQ ID NO: 199762
  derived and/or modified sequence opt5 from neuraminidase__InfluenzaA__ACZ96060

SEQ ID NO: 200802 - RNA, 1410 nt, Artificial Sequence; identical to SEQ ID NO: 199762
  derived and/or modified sequence opt5 from neuraminidase__InfluenzaA__ACZ96072

SEQ ID NO: 200803 - RNA, 1410 nt, Artificial Sequence; identical to SEQ ID NO: 199762
  derived and/or modified sequence opt5 from neuraminidase__InfluenzaA__ACZ96082

SEQ ID NO: 200804 - RNA, 1410 nt, Artificial Sequence; identical to SEQ ID NO: 199762
  derived and/or modified sequence opt5 from neuraminidase__InfluenzaA__ACZ96092

SEQ ID NO: 200805 - RNA, 1410 nt, Artificial Sequence; identical to SEQ ID NO: 199762
  derived and/or modified sequence opt5 from neuraminidase__InfluenzaA__ACZ96102

SEQ ID NO: 200806 - RNA, 1410 nt, Artificial Sequence; identical to SEQ ID NO: 199762
  derived and/or modified sequence opt5 from neuraminidase__InfluenzaA__ACZ96112

SEQ ID NO: 200807 - RNA, 1410 nt, Artificial Sequence
  derived and/or modified sequence opt5 from neuraminidase__InfluenzaA__ACZ96122
augaaccccaaucagaagaucauuaccaucggcagcgugugcaugacaauugggauggccaaccugauccuccaaauuggaaauaucaucuccauuuggaucucucacagcauucagcugggcaaccagaaucagaucgaggcuuguaaccaauccgucauuacguacgaaaauaacaccuggguuaaucagacauaugugaacaucucuaauaccaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaaggacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacaccaucuggacauccgggagcucuauuuccuuuuguggaaucaauagcgacacgguuggcuggucuuggcccgauggggccgagcugccuuucaccaucgacaaauga

SEQ ID NO: 200808 - RNA, 1410 nt, Artificial Sequence; identical to SEQ ID NO: 199762
  derived and/or modified sequence opt5 from neuraminidase__InfluenzaA__ACZ96132

SEQ ID NO: 200809 - RNA, 1410 nt, Artificial Sequence; identical to SEQ ID NO: 199762
  derived and/or modified sequence opt5 from neuraminidase__InfluenzaA__ACZ96142

SEQ ID NO: 200810 - RNA, 1410 nt, Artificial Sequence; identical to SEQ ID NO: 199762
  derived and/or modified sequence opt5 from neuraminidase__InfluenzaA__ACZ96152

SEQ ID NO: 200811 - RNA, 1410 nt, Artificial Sequence; identical to SEQ ID NO: 199762
  derived and/or modified sequence opt5 from neuraminidase__InfluenzaA__ACZ96162

SEQ ID NO: 200812 - RNA, 1410 nt, Artificial Sequence; identical to SEQ ID NO: 199762
  derived and/or modified sequence opt5 from neuraminidase__InfluenzaA__ACZ96172

SEQ ID NO: 200813 - RNA, 1410 nt, Artificial Sequence
  derived and/or modified sequence opt5 from neuraminidase__InfluenzaA__ACZ96182
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacagacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 200814 - RNA, 1410 nt, Artificial Sequence
  derived and/or modified sequence opt5 from neuraminidase__InfluenzaA__ACZ96192
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgcuccaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 200815 - RNA, 1410 nt, Artificial Sequence
  derived and/or modified sequence opt5 from neuraminidase__InfluenzaA__ACZ96232
augaaccccaaucagaagaucauuaccaucggcagcgugugcaugacagucgggauggccaaccugauucuccaaaucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaaugacuuuagcauuaagcaagauaucgucggcaucaacgaaugguccggguacucuggcagcuucgugcagcaucccgagcuuacaggacuggacuguauucgcccuugcuucuggguugaacucaucagaggccggcccaaagagaauacgauuuggaccuccgggagcucuaucuccuuuuguggagugaacagcgauacagucggcuggucuuggcccgacggggcugagcugccuuucaccauugauaaguga

SEQ ID NO: 200816 - RNA, 1410 nt, Artificial Sequence
  derived and/or modified sequence opt5 from neuraminidase__InfluenzaA__ACZ96242
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagaguccacgaucuggaccagcgggucuuccauuagcuuuuguggaguuaacucugacacagugggcugguccuggcccgauggggcugagcugccuuucaccaucgacaaguga

SEQ ID NO: 200817 - RNA, 1410 nt, Artificial Sequence; identical to SEQ ID NO: 199762
  derived and/or modified sequence opt5 from neuraminidase__InfluenzaA__ACZ96252

SEQ ID NO: 200818 - RNA, 1410 nt, Artificial Sequence; identical to SEQ ID NO: 199762
  derived and/or modified sequence opt5 from neuraminidase__InfluenzaA__ACZ96292

SEQ ID NO: 200819 - RNA, 1410 nt, Artificial Sequence; identical to SEQ ID NO: 199762
  derived and/or modified sequence opt5 from neuraminidase__InfluenzaA__ACZ96302

SEQ ID NO: 200820 - RNA, 1410 nt, Artificial Sequence; identical to SEQ ID NO: 199762
  derived and/or modified sequence opt5 from neuraminidase__InfluenzaA__ACZ96312

SEQ ID NO: 200821 - RNA, 1410 nt, Artificial Sequence
  derived and/or modified sequence opt5 from neuraminidase__InfluenzaA__ACZ96322
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuaccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugcuuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 200822 - RNA, 1410 nt, Artificial Sequence; identical to SEQ ID NO: 200821
  derived and/or modified sequence opt5 from neuraminidase__InfluenzaA__ACZ96332

SEQ ID NO: 200823 - RNA, 1410 nt, Artificial Sequence; identical to SEQ ID NO: 199762
  derived and/or modified sequence opt5 from neuraminidase__InfluenzaA__ACZ96352

SEQ ID NO: 200824 - RNA, 1410 nt, Artificial Sequence; identical to SEQ ID NO: 200821
  derived and/or modified sequence opt5 from neuraminidase__InfluenzaA__ACZ96362

SEQ ID NO: 200825 - RNA, 1410 nt, Artificial Sequence; identical to SEQ ID NO: 199762
  derived and/or modified sequence opt5 from neuraminidase__InfluenzaA__ACZ96375

SEQ ID NO: 200826 - RNA, 1410 nt, Artificial Sequence; identical to SEQ ID NO: 200821
  derived and/or modified sequence opt5 from neuraminidase__InfluenzaA__ACZ96385

SEQ ID NO: 200827 - RNA, 1410 nt, Artificial Sequence
  derived and/or modified sequence opt5 from neuraminidase__InfluenzaA__ACZ96395
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucugugagaauuggguccaaaggagaugucuuugugauccgggagccguucaucagcuguucuccccucgaaugccgcacauuuuuccugacccagggcgcccuucugaaugacaagcauuccaacggcacgauuaaagauagaagcccuuaucggacccucaugucuugucccaucggggagguuccuucccccuacaacagccgcuuugaauccguggccuggucugcuagcgccugccacgacggaauuaauuggcugacaaucggcauuuccgggccugauaacggagcugucgccgugcugaaguauaauggcaucaucaccgacacaauuaagagcuggagaaacaauauccuccggacccaagagucugagugugcgugcgugaacggguccuguuucacggucaugacagauggaccgagcaauggccaggccucuuacaaaauuuuucgcaucgaaaagggcaaaauuguuaagagcguggagaugaacgcucccaauuaucauuacgaagagugcuccuguuacccugacucuagcgagauuaccugcgugugcagagauaacuggcacggguccaaucggcccugggucagcuucaaccagaaucuggaauaucagaucggauacaucuguucuggcaucuuuggggacaacccucgccccauugauaaaacaggauccugcggcccggugagcucuaauggggccaacggaguuaagggcuucuccuuuaaguauggcaacgggguguggaucggaagaaccaaaagcauuuccucucggaauggcuucgagaugaucugggacccuaacggguggaccggaacagauaauaacuuuagcauuaagcaagacaucgucggcaucaaugaaugguccggguacucuggcagcuucgugcagcaucccgagcuuacgggacuggacuguauucgcccuugcuucuggguugaacucaucagaggccggcccaaagagaacaccauuuggacauccgggagcucuaucuccuuuuguggagugaauagcgauaccgucggcuggucuuggcccgacggggcugagcugccuuucacaauugauaaguga

SEQ ID NO: 200828 - RNA, 1410 nt, Artificial Sequence; identical to SEQ ID NO: 199762
  derived and/or modified sequence opt5 from neuraminidase__InfluenzaA__ACZ96408

SEQ ID NO: 200829 - RNA, 1410 nt, Artificial Sequence; identical to SEQ ID NO: 199762
  derived and/or modified sequence opt5 from neuraminidase__InfluenzaA__ACZ96428

SEQ ID NO: 200830 - RNA, 1410 nt, Artificial Sequence; identical to SEQ ID NO: 199762
  derived and/or modified sequence opt5 from neuraminidase__InfluenzaA__ACZ96438

SEQ ID NO: 200831 - RNA, 1410 nt, Artificial Sequence; identical to SEQ ID NO: 199762
  derived and/or modified sequence opt5 from neuraminidase__InfluenzaA__ACZ96448

SEQ ID NO: 200832 - RNA, 1410 nt, Artificial Sequence; identical to SEQ ID NO: 199762
  derived and/or modified sequence opt5 from neuraminidase__InfluenzaA__ACZ96479

SEQ ID NO: 200833 - RNA, 1410 nt, Artificial Sequence; identical to SEQ ID NO: 200779
  derived and/or modified sequence opt5 from neuraminidase__InfluenzaA__ACZ96489

SEQ ID NO: 200834 - RNA, 1410 nt, Artificial Sequence; identical to SEQ ID NO: 199762
  derived and/or modified sequence opt5 from neuraminidase__InfluenzaA__ACZ96499

SEQ ID NO: 200835 - RNA, 1410 nt, Artificial Sequence
  derived and/or modified sequence opt5 from neuraminidase__InfluenzaA__ACZ96509
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggaucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 200836 - RNA, 1410 nt, Artificial Sequence; identical to SEQ ID NO: 199762
  derived and/or modified sequence opt5 from neuraminidase__InfluenzaA__ACZ96519

SEQ ID NO: 200837 - RNA, 1410 nt, Artificial Sequence; identical to SEQ ID NO: 199762
  derived and/or modified sequence opt5 from neuraminidase__InfluenzaA__ACZ96529

SEQ ID NO: 200838 - RNA, 1410 nt, Artificial Sequence
  derived and/or modified sequence opt5 from neuraminidase__InfluenzaA__ACZ96552
augaaccccaaucagaagaucauuaccaucggcagcgugugcaugacaauugggauggccaaccugauccuccaaauuggaaauaucaucuccauuuggaucucucacagcucccagcugggcaaccagaaucagauugagacguguaaccaaucugucaucaccuacgaaaauaacacauggguuaaucagaccuaugugaacauuagcaauacaaacuucgcugccgggcaguccguggucucugugaaacuugcgggaaauagcucccugugcccuguuagcggcugggcuaucuacucuaaggacaacuccauuagaaucgggagcaaaggagauguguuugucauccgggagccguucauuucuuguagcccccucgaaugccgcaccuuuuuccugacacagggcgcccuucugaaugacaagcauuccaacggcaccaucaaagauagaucuccuuaucggacgcucauguccugucccauuggggaggugccuagccccuacaacucccgcuuugaaucuguugccuggagcgcuuccgccugccacgacggaaucaauuggcugaccauuggcaucagcgggccugauaacggagcuguggccguccugaaguauaauggcaucauuacagacaccaucaagucuuggagaaacaauauucuccggacacaagaguccgagugugcgugcgugaacgggagcuguuucaccgugaugacggauggaccgucugacggccaggccagcuacaaaaucuuucgcauugaaaagggcaaaaucgucaaguccguugagaugaaugcucccaacuaucauuacgaagagugcucuuguuacccugauagcuccgagaucacaugcgugugcagagacaauuggcacgggagcaaccggcccugggugucuuucaaucagaaccuggaauaucagauuggauacaucuguuccggcauuuuuggggauaauccucgccccaacgacaaaaccggaagcugcggcccggucucuuccaauggggccaacggagugaagggcuucagcuuuaaguauggcaacgggguuuggaucggaagaacaaaauccauuucuagccggaauggcuucgagaugaucugggauccuaacggguggaccggaaccgacaauaacuuuuccauuaagcaagacaucgugggcaucaaugaauggucuggguacagcggcuccuucguccagcaucccgagcuuacaggacuggauuguauucgcccuugcuucuggguggaacucaucagaggccggcccaaagagaacacgauuuggaccagcgggucuuccaucagcuuuuguggaguuaauucugacacagugggcugguccuggcccgauggggcugagcugccuuucaccauugacaaguga

SEQ ID NO: 200839 - RNA, 1410 nt, Artificial Sequence; identical to SEQ ID NO: 199762
  derived and/or modified sequence opt5 from neuraminidase__InfluenzaA__ACZ96562

SEQ ID NO: 200840 - RNA, 1410 nt, Artificial Sequence; identical to SEQ ID NO: 199762
  derived and/or modified sequence opt5 from neuraminidase__InfluenzaA__ACZ96572

SEQ ID NO: 200841 - RNA, 1410 nt, Artificial Sequence; identical to SEQ ID NO: 199762
  derived and/or modified sequence opt5 from neuraminidase__InfluenzaA__ACZ96582

SEQ ID NO: 200842 - RNA, 1410 nt, Artificial Sequence
  derived and/or modified sequence opt5 from neuraminidase__InfluenzaA__ACZ96592
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccagucuagcuacaaaauuuuuaagaucgaaaaaggcaagaucgucaaauccguugagaugaaugcccccaacuaucauuacgaagagugcucuuguuacccugauagcuccgagauuacaugcgugugccgcgacaauuggcacgggagcaacagacccugggugucuuucaaucagaaccuggaauaucagaucggauacauuuguuccggcaucuuuggggauaauccucggcccaacgacaagaccggaagcugcggcccggucucuuccaauggggcuaacggagugaagggcuucagcuuuaaauauggcaacgggguuuggauuggacgcacaaaguccaucucuagcagaaauggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccggccuugcuucuggguggaacucauucgcggcagacccaaggagaacacgaucuggaccagcgggucuuccauuagcuuuuguggaguuaauucugacacagugggcugguccuggcccgauggggccgagcugccuuucaccaucgacaaauga

SEQ ID NO: 200843 - RNA, 1410 nt, Artificial Sequence; identical to SEQ ID NO: 199762
  derived and/or modified sequence opt5 from neuraminidase__InfluenzaA__ACZ96602

SEQ ID NO: 200844 - RNA, 1410 nt, Artificial Sequence
  derived and/or modified sequence opt5 from neuraminidase__InfluenzaA__ACZ96612
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucguuaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucugucagaauuggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucguucagcaucccgagcuuacaggacuggacuguauccgcccuugcuucuggguggaacucauuagaggccggcccaaagagaauacgaucuggaccuccgggagcucuauuuccuuuuguggagucaacagcgauacagugggcuggucuuggcccgacggggcugagcugccuuucaccaucgauaaguga

SEQ ID NO: 200845 - RNA, 1410 nt, Artificial Sequence; identical to SEQ ID NO: 199792
  derived and/or modified sequence opt5 from neuraminidase__InfluenzaA__ACZ96622

SEQ ID NO: 200846 - RNA, 1410 nt, Artificial Sequence; identical to SEQ ID NO: 199792
  derived and/or modified sequence opt5 from neuraminidase__InfluenzaA__ACZ96632

SEQ ID NO: 200847 - RNA, 1410 nt, Artificial Sequence; identical to SEQ ID NO: 199792
  derived and/or modified sequence opt5 from neuraminidase__InfluenzaA__ACZ96642

SEQ ID NO: 200848 - RNA, 1410 nt, Artificial Sequence; identical to SEQ ID NO: 199792
  derived and/or modified sequence opt5 from neuraminidase__InfluenzaA__ACZ96652

SEQ ID NO: 200849 - RNA, 1410 nt, Artificial Sequence; identical to SEQ ID NO: 199792
  derived and/or modified sequence opt5 from neuraminidase__InfluenzaA__ACZ96662

SEQ ID NO: 200850 - RNA, 1410 nt, Artificial Sequence; identical to SEQ ID NO: 199792
  derived and/or modified sequence opt5 from neuraminidase__InfluenzaA__ACZ96672

SEQ ID NO: 200851 - RNA, 1410 nt, Artificial Sequence; identical to SEQ ID NO: 199792
  derived and/or modified sequence opt5 from neuraminidase__InfluenzaA__ACZ96682

SEQ ID NO: 200852 - RNA, 1410 nt, Artificial Sequence; identical to SEQ ID NO: 199792
  derived and/or modified sequence opt5 from neuraminidase__InfluenzaA__ACZ96692

SEQ ID NO: 200853 - RNA, 1410 nt, Artificial Sequence; identical to SEQ ID NO: 199792
  derived and/or modified sequence opt5 from neuraminidase__InfluenzaA__ACZ96702

SEQ ID NO: 200854 - RNA, 1410 nt, Artificial Sequence; identical to SEQ ID NO: 199792
  derived and/or modified sequence opt5 from neuraminidase__InfluenzaA__ACZ96712

SEQ ID NO: 200855 - RNA, 1410 nt, Artificial Sequence; identical to SEQ ID NO: 199792
  derived and/or modified sequence opt5 from neuraminidase__InfluenzaA__ACZ96722

SEQ ID NO: 200856 - RNA, 1410 nt, Artificial Sequence; identical to SEQ ID NO: 199792
  derived and/or modified sequence opt5 from neuraminidase__InfluenzaA__ACZ96732

SEQ ID NO: 200857 - RNA, 1410 nt, Artificial Sequence; identical to SEQ ID NO: 199792
  derived and/or modified sequence opt5 from neuraminidase__InfluenzaA__ACZ96742

SEQ ID NO: 200858 - RNA, 1410 nt, Artificial Sequence; identical to SEQ ID NO: 199752
  derived and/or modified sequence opt5 from neuraminidase__InfluenzaA__ACZ96752

SEQ ID NO: 200859 - RNA, 1410 nt, Artificial Sequence; identical to SEQ ID NO: 199752
  derived and/or modified sequence opt5 from neuraminidase__InfluenzaA__ACZ96762

SEQ ID NO: 200860 - RNA, 1410 nt, Artificial Sequence; identical to SEQ ID NO: 199752
  derived and/or modified sequence opt5 from neuraminidase__InfluenzaA__ACZ96772

SEQ ID NO: 200861 - RNA, 1410 nt, Artificial Sequence; identical to SEQ ID NO: 199752
  derived and/or modified sequence opt5 from neuraminidase__InfluenzaA__ACZ96782

SEQ ID NO: 200862 - RNA, 1410 nt, Artificial Sequence; identical to SEQ ID NO: 199752
  derived and/or modified sequence opt5 from neuraminidase__InfluenzaA__ACZ96792

SEQ ID NO: 200863 - RNA, 1410 nt, Artificial Sequence; identical to SEQ ID NO: 199762
  derived and/or modified sequence opt5 from neuraminidase__InfluenzaA__ACZ96802

SEQ ID NO: 200864 - RNA, 1410 nt, Artificial Sequence; identical to SEQ ID NO: 199762
  derived and/or modified sequence opt5 from neuraminidase__InfluenzaA__ACZ96812

SEQ ID NO: 200865 - RNA, 1410 nt, Artificial Sequence; identical to SEQ ID NO: 200345
  derived and/or modified sequence opt5 from neuraminidase__InfluenzaA__ACZ96822

SEQ ID NO: 200866 - RNA, 1410 nt, Artificial Sequence
  derived and/or modified sequence opt5 from neuraminidase__InfluenzaA__ACZ96842
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcaauggccaggccucuuacaaaaucuuucgcauugaaaagggcaaaaucguuaagagcguggagaugaucgcucccaacuaucauuacgaagagugcuccuguuacccugacucuagcgagauuacaugcgugugcagagauaauuggcacggguccaaccggcccugggucagcuucaaucagaaccuggaauaucagaucggauacauuuguucuggcaucuuuggggacaauccucgccccaacgauaaaaccggauccugcggcccggugagcucuaauggggccaacggaguuaagggcuucuccuuuaaguauggcaacgggguguggauuggaagaacaaaaagcaucuccucucggaauggcuucgagaugauuugggacccuaacggguggaccggaaccgauaauaacuuuagcaucaagcaagacaucgucggcauuaaugaaugguccggguacucuggcagcuucgugcagcaucccgagcuuacaggacuggacuguauccgcccuugcuucuggguugaacucauuagaggccggcccaaagagaacacgaucuggaccuccgggagcucuauuuccuuuuguggagugaauagcgauacagucggcuggucuuggcccgacggggcugagcugccuuucaccaucgauaaguga

SEQ ID NO: 200867 - RNA, 1410 nt, Artificial Sequence; identical to SEQ ID NO: 199762
  derived and/or modified sequence opt5 from neuraminidase__InfluenzaA__ACZ96852

SEQ ID NO: 200868 - RNA, 1410 nt, Artificial Sequence; identical to SEQ ID NO: 199762
  derived and/or modified sequence opt5 from neuraminidase__InfluenzaA__ACZ96862

SEQ ID NO: 200869 - RNA, 1410 nt, Artificial Sequence
  derived and/or modified sequence opt5 from neuraminidase__InfluenzaA__ACZ96872
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccuguguccggcugggcuauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 200870 - RNA, 1410 nt, Artificial Sequence; identical to SEQ ID NO: 199752
  derived and/or modified sequence opt5 from neuraminidase__InfluenzaA__ACZ96882

SEQ ID NO: 200871 - RNA, 1410 nt, Artificial Sequence; identical to SEQ ID NO: 200869
  derived and/or modified sequence opt5 from neuraminidase__InfluenzaA__ACZ96892

SEQ ID NO: 200872 - RNA, 1410 nt, Artificial Sequence; identical to SEQ ID NO: 200869
  derived and/or modified sequence opt5 from neuraminidase__InfluenzaA__ACZ96902

SEQ ID NO: 200873 - RNA, 1410 nt, Artificial Sequence; identical to SEQ ID NO: 199752
  derived and/or modified sequence opt5 from neuraminidase__InfluenzaA__ACZ96912

SEQ ID NO: 200874 - RNA, 1410 nt, Artificial Sequence; identical to SEQ ID NO: 199752
  derived and/or modified sequence opt5 from neuraminidase__InfluenzaA__ACZ96922

SEQ ID NO: 200875 - RNA, 1410 nt, Artificial Sequence; identical to SEQ ID NO: 200869
  derived and/or modified sequence opt5 from neuraminidase__InfluenzaA__ACZ96932

SEQ ID NO: 200876 - RNA, 1410 nt, Artificial Sequence; identical to SEQ ID NO: 200869
  derived and/or modified sequence opt5 from neuraminidase__InfluenzaA__ACZ96942

SEQ ID NO: 200877 - RNA, 1410 nt, Artificial Sequence; identical to SEQ ID NO: 199752
  derived and/or modified sequence opt5 from neuraminidase__InfluenzaA__ACZ96952

SEQ ID NO: 200878 - RNA, 1410 nt, Artificial Sequence; identical to SEQ ID NO: 199752
  derived and/or modified sequence opt5 from neuraminidase__InfluenzaA__ACZ97024

SEQ ID NO: 200879 - RNA, 1410 nt, Artificial Sequence; identical to SEQ ID NO: 200869
  derived and/or modified sequence opt5 from neuraminidase__InfluenzaA__ACZ97336

SEQ ID NO: 200880 - RNA, 1410 nt, Artificial Sequence; identical to SEQ ID NO: 200869
  derived and/or modified sequence opt5 from neuraminidase__InfluenzaA__ACZ97346

SEQ ID NO: 200881 - RNA, 1410 nt, Artificial Sequence; identical to SEQ ID NO: 199762
  derived and/or modified sequence opt5 from neuraminidase__InfluenzaA__ACZ97366

SEQ ID NO: 200882 - RNA, 1410 nt, Artificial Sequence; identical to SEQ ID NO: 199762
  derived and/or modified sequence opt5 from neuraminidase__InfluenzaA__ACZ97376

SEQ ID NO: 200883 - RNA, 1410 nt, Artificial Sequence; identical to SEQ ID NO: 199762
  derived and/or modified sequence opt5 from neuraminidase__InfluenzaA__ACZ97386

SEQ ID NO: 200884 - RNA, 1410 nt, Artificial Sequence; identical to SEQ ID NO: 200869
  derived and/or modified sequence opt5 from neuraminidase__InfluenzaA__ACZ97396

SEQ ID NO: 200885 - RNA, 1410 nt, Artificial Sequence; identical to SEQ ID NO: 199762
  derived and/or modified sequence opt5 from neuraminidase__InfluenzaA__ACZ98171

SEQ ID NO: 200886 - RNA, 1410 nt, Artificial Sequence; identical to SEQ ID NO: 199762
  derived and/or modified sequence opt5 from neuraminidase__InfluenzaA__ACZ98181

SEQ ID NO: 200887 - RNA, 1410 nt, Artificial Sequence
  derived and/or modified sequence opt5 from neuraminidase__InfluenzaA__ACZ98191
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuucuuacgaaaauaacaccuggguuaaucagacauaugugaacaucagcaauaccaacuucgcugccgggcaguccguggucucugugaaacuugcgggaaauagcucccugugcccuguuagcggcugggcuauuuacucuaaggacaacuccaucagaaucgggagcaaaggagauguguuugucauucgggagccguucaucucuuguagcccccucgaaugccgcacauuuuuccugacccagggcgcccuucugaaugacaagcauuccaacggcacaauuaaagauagaucuccuuaucggacccucauguccugucccaucggggaggugccuagccccuacaacucccgcuuugaaucuguugccuggagcgcuuccgccugccacgacggaauuaauuggcugacgaucggcaucagcgggccugauaacggagcuguggccguccugaaguauaauggcauuaucaccgacacaauuaagucuuggagaaacaauauccuccggacccaagaguccgagugugcgugcgugaacgggagcuguuucacagugaugaccgauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacgugcgugugcagagacaauuggcacgggagcaaccggcccugggugucuuucaaucagaaccuggaauaucagaucggauacauuuguuccggcaucuuuggggauaauccucgccccaacgacaaaacaggaagcugcggcccggucucuuccaauggggccaacggagugaagggcuucagcuuuaaguauggcaacgggguuuggauuggaagaaccaaauccaucucuagccggaauggcuucgagaugauuugggauccuaacggguggacaggaaccgacaauaacuuuuccaucaagcaagacaucgugggcauuaaugaauggucuggguacagcggcuccuucguccagcaucccgagcuuaccggacuggauuguauccgcccuugcuucuggguggaacucauuagaggccggcccaaagagaacacaaucuggacgagcgggucuuccauuagcuuuuguggaguuaauucugacaccgugggcugguccuggcccgauggggcugagcugccuuucacaaucgacaaguga

SEQ ID NO: 200888 - RNA, 1410 nt, Artificial Sequence; identical to SEQ ID NO: 199752
  derived and/or modified sequence opt5 from neuraminidase__InfluenzaA__ACZ98201

SEQ ID NO: 200889 - RNA, 1410 nt, Artificial Sequence; identical to SEQ ID NO: 199762
  derived and/or modified sequence opt5 from neuraminidase__InfluenzaA__ACZ98211

SEQ ID NO: 200890 - RNA, 1410 nt, Artificial Sequence; identical to SEQ ID NO: 199762
  derived and/or modified sequence opt5 from neuraminidase__InfluenzaA__ACZ98221

SEQ ID NO: 200891 - RNA, 1410 nt, Artificial Sequence; identical to SEQ ID NO: 199762
  derived and/or modified sequence opt5 from neuraminidase__InfluenzaA__ACZ98231

SEQ ID NO: 200892 - RNA, 1410 nt, Artificial Sequence; identical to SEQ ID NO: 199762
  derived and/or modified sequence opt5 from neuraminidase__InfluenzaA__ACZ98241

SEQ ID NO: 200893 - RNA, 1410 nt, Artificial Sequence; identical to SEQ ID NO: 200739
  derived and/or modified sequence opt5 from neuraminidase__InfluenzaA__ACZ98251

SEQ ID NO: 200894 - RNA, 1410 nt, Artificial Sequence; identical to SEQ ID NO: 199762
  derived and/or modified sequence opt5 from neuraminidase__InfluenzaA__ACZ98261

SEQ ID NO: 200895 - RNA, 1410 nt, Artificial Sequence; identical to SEQ ID NO: 199762
  derived and/or modified sequence opt5 from neuraminidase__InfluenzaA__ACZ98271

SEQ ID NO: 200896 - RNA, 1410 nt, Artificial Sequence; identical to SEQ ID NO: 199762
  derived and/or modified sequence opt5 from neuraminidase__InfluenzaA__ACZ98281

SEQ ID NO: 200897 - RNA, 1410 nt, Artificial Sequence; identical to SEQ ID NO: 199762
  derived and/or modified sequence opt5 from neuraminidase__InfluenzaA__ACZ98291

SEQ ID NO: 200898 - RNA, 1410 nt, Artificial Sequence; identical to SEQ ID NO: 199752
  derived and/or modified sequence opt5 from neuraminidase__InfluenzaA__ACZ98301

SEQ ID NO: 200899 - RNA, 1410 nt, Artificial Sequence
  derived and/or modified sequence opt5 from neuraminidase__InfluenzaA__ACZ98321
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucaauucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 200900 - RNA, 1410 nt, Artificial Sequence; identical to SEQ ID NO: 199762
  derived and/or modified sequence opt5 from neuraminidase__InfluenzaA__ACZ98331

SEQ ID NO: 200901 - RNA, 1410 nt, Artificial Sequence
  derived and/or modified sequence opt5 from neuraminidase__InfluenzaA__ACZ98341
augaaccccaaucagaagaucauuaccaucggcagcgugugcauuacaaucgggauggccaaccugauucuccaaaucggaaauaucauuuccaucuggauuucucacccuauccagcugggcaaccagaaucagauugagacguguaaccaaagcgucaucaccuacgaaaauaacacauggguuaaucagaccuaugugaacauuuccaauacaaaccuugcugccgggcagucuguggucagcgugaaacuggcgggaaauuccucucucugcccgguuagcggcugggcuaucuacuccaaggacaacagcaucagaauugggucuaaaggagauguguucgucauccgggagcccuuuauuuccuguagcccucuggaaugccgcaccuucuuucuuacacagggcgcccugcucaaugacaagcauucuaacggcaccaucaaagauagaucccccuaucggacgcugaugagcuguccuauuggggaggugcccucuccuuacaacucccgcuucgaaagcguugccugguccgcuucugccugccacgacggaaucaauuggcugaccaucggcauuagcgggccggauaacggagcuguggccguccucaaguauaauggcaucauuacagacaccaucaaguccuggagaaacaauauucugcggacacaagagagcgagugugcgugcgugaacgggucuuguuuuaccgugaugacggauggacccuccgacggccaggccagcuacaaaaucuuccgcaucgaaaagggcaaaauugucaagucuguugagaugaaugcuccuaacuaucauuacgaagagugcagcuguuaccccgauuccucugagaucacaugcgugugcagagacaauuggcacgggagcaaccggccuuggguguccuuuaaucagaaccuugaauaucagauuggauacaucuguagcggcauuuucggggauaauccccgcccgaacgacaaaaccggaucuugcggcccugucuccagcaauggggccaacggagugaagggcuuuucuuucaaguauggcaacgggguuuggaucggaagaacaaaauccauuagcucccggaauggcuuugagaugaucugggaucccaacggguggaccggaaccgacaauaacuucucuaucaagcaagacauugugggcaucaaugaauggagcggguacuccggcucuuuuguccagcauccugagcugacaggacucgauuguauucgccccugcuucuggguggaacugaucagaggccggcccaaagagaacacgauuuggaccagcggguccagcaucucuuucuguggaguuaauuccgacacagugggcuggagcuggccugauggggcugagcuuccguuuaccaucgacaaguga

SEQ ID NO: 200902 - RNA, 1410 nt, Artificial Sequence; identical to SEQ ID NO: 199762
  derived and/or modified sequence opt5 from neuraminidase__InfluenzaA__ACZ98351

SEQ ID NO: 200903 - RNA, 1410 nt, Artificial Sequence; identical to SEQ ID NO: 199762
  derived and/or modified sequence opt5 from neuraminidase__InfluenzaA__ACZ98361

SEQ ID NO: 200904 - RNA, 1410 nt, Artificial Sequence; identical to SEQ ID NO: 199762
  derived and/or modified sequence opt5 from neuraminidase__InfluenzaA__ACZ98371

SEQ ID NO: 200905 - RNA, 1410 nt, Artificial Sequence; identical to SEQ ID NO: 199762
  derived and/or modified sequence opt5 from neuraminidase__InfluenzaA__ACZ98381

SEQ ID NO: 200906 - RNA, 1410 nt, Artificial Sequence; identical to SEQ ID NO: 199762
  derived and/or modified sequence opt5 from neuraminidase__InfluenzaA__ACZ98391

SEQ ID NO: 200907 - RNA, 1410 nt, Artificial Sequence; identical to SEQ ID NO: 199762
  derived and/or modified sequence opt5 from neuraminidase__InfluenzaA__ACZ98401

SEQ ID NO: 200908 - RNA, 1410 nt, Artificial Sequence; identical to SEQ ID NO: 199762
  derived and/or modified sequence opt5 from neuraminidase__InfluenzaA__ACZ98411

SEQ ID NO: 200909 - RNA, 1410 nt, Artificial Sequence; identical to SEQ ID NO: 199792
  derived and/or modified sequence opt5 from neuraminidase__InfluenzaA__ACZ98421

SEQ ID NO: 200910 - RNA, 1410 nt, Artificial Sequence; identical to SEQ ID NO: 199762
  derived and/or modified sequence opt5 from neuraminidase__InfluenzaA__ACZ98431

SEQ ID NO: 200911 - RNA, 1410 nt, Artificial Sequence; identical to SEQ ID NO: 199762
  derived and/or modified sequence opt5 from neuraminidase__InfluenzaA__ACZ98441

SEQ ID NO: 200912 - RNA, 1410 nt, Artificial Sequence; identical to SEQ ID NO: 199762
  derived and/or modified sequence opt5 from neuraminidase__InfluenzaA__ACZ98451

SEQ ID NO: 200913 - RNA, 1410 nt, Artificial Sequence; identical to SEQ ID NO: 199762
  derived and/or modified sequence opt5 from neuraminidase__InfluenzaA__ACZ98461

SEQ ID NO: 200914 - RNA, 1410 nt, Artificial Sequence; identical to SEQ ID NO: 200345
  derived and/or modified sequence opt5 from neuraminidase__InfluenzaA__ACZ98674

SEQ ID NO: 200915 - RNA, 1410 nt, Artificial Sequence; identical to SEQ ID NO: 200869
  derived and/or modified sequence opt5 from neuraminidase__InfluenzaA__ACZ98684

SEQ ID NO: 200916 - RNA, 1410 nt, Artificial Sequence; identical to SEQ ID NO: 200815
  derived and/or modified sequence opt5 from neuraminidase__InfluenzaA__ACZ98694

SEQ ID NO: 200917 - RNA, 1410 nt, Artificial Sequence; identical to SEQ ID NO: 199762
  derived and/or modified sequence opt5 from neuraminidase__InfluenzaA__ADA60801

SEQ ID NO: 200918 - RNA, 1410 nt, Artificial Sequence; identical to SEQ ID NO: 199762
  derived and/or modified sequence opt5 from neuraminidase__InfluenzaA__ADA69294

SEQ ID NO: 200919 - RNA, 1410 nt, Artificial Sequence; identical to SEQ ID NO: 199762
  derived and/or modified sequence opt5 from neuraminidase__InfluenzaA__ADA69304

SEQ ID NO: 200920 - RNA, 1410 nt, Artificial Sequence; identical to SEQ ID NO: 199762
  derived and/or modified sequence opt5 from neuraminidase__InfluenzaA__ADA69314

SEQ ID NO: 200921 - RNA, 1410 nt, Artificial Sequence; identical to SEQ ID NO: 199762
  derived and/or modified sequence opt5 from neuraminidase__InfluenzaA__ADA69324

SEQ ID NO: 200922 - RNA, 1410 nt, Artificial Sequence; identical to SEQ ID NO: 199762
  derived and/or modified sequence opt5 from neuraminidase__InfluenzaA__ADA69334

SEQ ID NO: 200923 - RNA, 1410 nt, Artificial Sequence; identical to SEQ ID NO: 199762
  derived and/or modified sequence opt5 from neuraminidase__InfluenzaA__ADA69451

SEQ ID NO: 200924 - RNA, 1410 nt, Artificial Sequence; identical to SEQ ID NO: 199762
  derived and/or modified sequence opt5 from neuraminidase__InfluenzaA__ADA69453

SEQ ID NO: 200925 - RNA, 1410 nt, Artificial Sequence
  derived and/or modified sequence opt5 from neuraminidase__InfluenzaA__ADA71153
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccagcagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucgugucccgguacgucuguagcggacuugugggcgaucccccgcgcaagaaugacucuagcuccucuagccauugccuggauccuaacaaugaagagggcgggcacggaguuaaaggcugggccuucgacgaugggaacgacguguggaugggaagaaccauuuccgaaaagagccggcucggcuaugagacguuuaaagucaucgagggguggucuaaucccaaguccaaacugcagaucaaccgccaggugauugucgauagaggaaaucggagcggcuacucuggcaucuucuccguggaagggaagucuuguauuaacagaugcuuuuauguugagcugauccgcggacggaaggaagagacagaagugcucuggaccuccaauucuauugucguguucuguggcaccagcgggacauacggaaccggcuccuggccugacggggcuaacaucaaucugaugcccauuuga

SEQ ID NO: 200926 - RNA, 1413 nt, Artificial Sequence
  derived and/or modified sequence opt5 from neuraminidase__InfluenzaA__ADA71155
augaaccccaaucagaagaucauuaccaucggcagcauuuccaucgccauugggaucaucucucugaugcuccaaauuggaaacaucauuagcaucugggcuucccacucuauucagaucggcagccagaauaacacagggauuugcaaucagagaaucaucacguacgagaacuccaccugggugaaucauacauaugucaacauuaauaacaccaaaguuguggccggagaagacaagacaucugugacccuggcgggcaauagcucccuuuguagcaucucugggugggcuauuuacacaaaagauaacuccauccggauuggaagcaagggcgacgucuucgugauccgcgagccuuuuaucucuugcucccaccuggaauguagaaccuucuuucucacgcaaggcgcccugcuuaaugauaaacauagcaacgggaccguuaaggaccggucuccguaucgcgcccugauguccugcccccucggagaggcuccuagccccuacaauuccaaguucgaaucuguggccuggagcgcuuccgccugucacgauggcaugggguggcugacaauuggaaucagcggcccugacaacggggcggucgccgugcugaaauauaacggaauuaucaccggcacaauuaagucuuggaaaaagcagauccucagaacccaggaguccgagugcguuuguaugaauggcagcugcuuuacgaucaugacagaugggcccucuaacaaagcugccagcuacaagauuuucaagaucgaaaaaggaaaggugaccaaauccauugagcugaaugcuccuaacuuuuauuacgaagaguguucuugcuacccggacacaggcaucgucaugugugugugccgggauaauuggcaugggagcaaccgccccuggguguccuucaaucagaaccuugacuaucaaauuggauacaucugcagcggcgucuuuggggauaauccuagacccgaggacggagaaggcucuuguaacccuguuaccguggauggcgccaauggggugaagggauucuccuauaaauacggcaacggggucuggauuggacggaccaagagcaaucgccugagaaaaggcuuugagaugaucugggaccccaacggguggacaaauacggacucugauuucuccgugaagcaggacguuguggcgaucaccgauuggagcggcuauuccggaucuuuuguccagcacccggaacucacaggccuggacugcauucggccuuguuucuggguggagcuuguucgcgggcugcccagagaaaacaccacaaucuggaccagcggauccucuauuagcuucugcggcgugaacuccgauacggccaauuggagcuggccugacggggcugagcuccccuuuacaaucgauaaguga

SEQ ID NO: 200927 - RNA, 1413 nt, Artificial Sequence; identical to SEQ ID NO: 200485
  derived and/or modified sequence opt5 from neuraminidase__InfluenzaA__ADA71157

SEQ ID NO: 200928 - RNA, 1413 nt, Artificial Sequence
  derived and/or modified sequence opt5 from neuraminidase__InfluenzaA__ADA71159
augaaccccaaucagaagaucauuaccaucggcagcauuuccaucgccauugggaucaucucucugaugcuccaaauuggaaacaucauuagcaucugggcuucccacucuauucagaucggcagccagaauaacacagggauuugcaaucagagaaucaucacguacgagaacuccaccugggugaaucauacauaugugaacauuaauaacaccaaaguuguggccggagaaggcaagacaucugugacccuggcggggaauagcucccuuuguagcaucucuggaugggcuauuaacacaaaagacaauuccauccggauuggcagcaagggcgaugucuucgugauccgcgagccuuuuaucucuugcucccaccuggaauguagaaccuucuuucucacgcaaggggcccugcuuaacgacaaacauagcaaucggaccguuaaggaucgcucuccguacagagcccugauguccugcccccucggagaggcuccuagccccuauaacuccaaguucgaaucuguggccuggagcgcuuccgccugucacgacggcaugggguggcugacaauuggaaucagcggcccugauaacggggcggucgccgugcugaaauacaauggaauuaucaccggcacaauuaagucuuggaaaaagcagauccuccggacccaggaguccgagugcguuuguaugaacggcagcugcuuuacgaucaugacagacgggcccucuaauaaagcugccagcuauaagauuuucaagaucgaaaaaggaaaggugaccaaauccauugagcugaacgcuccuaauuuuuacuaugaagaguguucuugcuacccggauacaggcaucgucaugugugugugccgcgacaacuggcaugggagcaauagacccuggguguccuucaaccagaaucuugauuaccaaauuggauauaucugcagcggcgucuuuggggacaacccucggcccgaggauggagaaggcucuuguaauccuguuaccguggacggcgccaacggggugaagggauucuccuacaaauauggcaauggggucuggauuggacgcaccaagagcaacagacugcggaaaggcuuugagaugaucugggaucccaauggguggacaaacacggacucugacuucuccgugaagcaggauguuguggcgaucaccgacuggagcggcuacuccggaucuuuuguccagcacccggaacucacaggccuggauugcauucgcccuuguuucuggguggagcuuguuagagggcugccccgggaaaacaccacaaucuggaccagcggauccucuauuagcuucugcggcgucaauuccgacacggccaacuggagcuggccugauggggcugagcuccccuuuacaaucgacaaguga

SEQ ID NO: 200929 - RNA, 1410 nt, Artificial Sequence
  derived and/or modified sequence opt5 from neuraminidase__InfluenzaA__ADA71161
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggccugauggggcugaccugaaccuuaugcccauuuga

SEQ ID NO: 200930 - RNA, 1413 nt, Artificial Sequence
  derived and/or modified sequence opt5 from neuraminidase__InfluenzaA__ADA71165
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuccaagauugaaaagggaaaagugacaaagucuaucgagcugaacgcuccuaauuucuauuacgaagaguguagcugcuacccggacaccggcauugucaugugugugugccgggauaacuggcauggguccaaucgccccugggugagcuuuaaccagaaucuugacuaucaaaucggauacauuugcucuggcgucuucggggauaacccuagacccgaggacggagaaggcuccuguaauccuguuaccguggauggcgccaacggggugaaaggauuuagcuauaaguacggcaauggggucuggaucggacggacaaaaucuaaccgccugagaaagggcuucgagaugauuugggaccccaauggguggacgaacaccgacuccgauuuuagcgugaaacaggacguuguggcgaucacagauugguccggcuauucuggcagcuucguccagcacccggaacucaccggacuggacugcauccggccuuguuuuuggguggagcuuguucgcgggcugcccagagaaaacacaaccauuuggacguccggaucuagcaucuccuucugcggcgugaauagcgauacagccaacuggucuuggccugacggggcugagcuccccuucaccauugauaaguga

SEQ ID NO: 200931 - RNA, 1410 nt, Artificial Sequence
  derived and/or modified sequence opt5 from neuraminidase__InfluenzaA__ADA71167
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucggggccgcacgccguauagaacacuccugaugaaugaacugggggugcccuuucaccucggaaccaagcaggucugcauugccugguccucuagcuccugucaugauggcaaagccuggcugcacgugugcaucacaggcgacgauaagaacgcuaccgccagcuucauuuacaaugggcggcuuguugacucuguggucuccuggagcaaagauauccugcgcacccaggagucugaaugugugugcauuaacggaacauguacgguggucaugaccgacggcuccgcuagcgggaaggccgauacaaaaauccucuuuaucgaggagggaaagauuguucauaccuccacacugucuggcagcgcgcaacacguggaagagugcuccugcuauccuagauaccccggggugcggugugucugccgcgacaacuggaagggaagcaauagaccuaucguggauauuaacaucaaagaccacucuauuguuuccagcuacguguguucuggccuugucggcgacacgccccggaagaaugauagcuccucuagcucccauugccugaacccgaauaacgaagaagggggacacggcgugaaagggugggccuucgacgauggaaaugacguuuggaugggccgcaccaucagcgagaagucuagacucggguaugagacauuuaaagugaucgagggaugguccaacccuaagagcaaacugcagauuaaucggcaggucaucguggaucgcggcaacagaucuggcuacuccgggauuuucagcgucgaaggaaaguccuguaucaaucggugcuuuuauguggagcugauuagaggccgcaaggaagagaccgaaguucucuggaccucuaacagcaucguggucuucugugggacauccggaaccuacggcacagggucuuggcccgacggcgcuaauauuaaccugaugccuaucuga

SEQ ID NO: 200932 - RNA, 1413 nt, Artificial Sequence
  derived and/or modified sequence opt5 from neuraminidase__InfluenzaA__ADA71169
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggucggcaauucuagccuuuguuccauuagcgggugggcgaucuacaccaaagauaacucuauucggaucggauccaagggcgacguguucguuauucgcgagccguuuaucagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccauuggaaucuccggccccgacaacggggccguggcgguucugaaguauaaaggaauuaucacaggcaccauuaagagcuggaaaaagcagauccuccgcacgcaggaaucugagugcguguguaucaacggcuccugcuuuacaauuaugaccgaugggccuagcgacggagccgcuucuuacaagaucuucaaaauugagaagggcaaagucacaaagagcauggaacugaaugccccgaacuuucacuaugaggaauguuccugcuaccccgauaccgggaccgugaugugugugugcagagacaauuggcacggaucuaaccggccuugggucagcuucaaucagaaccuugauuaccaaaucggcuauauuugcuccgggguuuuuggagacaauccccgcccuaaagauggcgagggcagcuguaaccccgugacaguggacggggcuaauggagucaagggcuucucuuacaaauaugggaacggaguguggaucggcagaacgaaguccaaucggauucgcaagggguuugagaugaucugggacccgaacggcuggaccaauacagauagcgacuucucuguuaaacaggauaucguggccauuaccgacugguccggauacagcggcuccuuuguccagcauccugaacugacagggcucgauugcaucagacccuguuucuggguggagcugguucggggacuuccucgcgaaaacaccacgauuuggacaucuggcagcuccaucucuuucugcggggugaauggagacauugcgaacuggagcuggcccgauggcgccgagcugcccuuuaccaucgacaaguga

SEQ ID NO: 200933 - RNA, 1413 nt, Artificial Sequence; identical to SEQ ID NO: 200485
  derived and/or modified sequence opt5 from neuraminidase__InfluenzaA__ADA71171

SEQ ID NO: 200934 - RNA, 1410 nt, Artificial Sequence
  derived and/or modified sequence opt5 from neuraminidase__InfluenzaA__ADA71173
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggcccgcacgccguauagaacacuccugaugaaugaacugggcgugcccuuucaccucgggaccaagcaggucugcauugccugguccucuagcuccugucaugauggaaaggcuuggcugcacgugugcaucacaggcgacgauaaaaacgccaccgcuagcuucauuuacaauggccggcuuguugacucuguggucuccuggagcaaagauauccugcgcacccaggagucugaaugugugugcauuaacgggacauguacgguggucaugaccgacggauccgccagcggcaaggcggauacaaaaauccucuuuaucgaggaggggaagauuguucauaccuccacacugucuggaagcgcccaacacguggaagagugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccugaacccgaauaacgaagagggcgggcacggagugaaaggcugggcuuucgacgaugggaaugacguuuggaugggacgcaccaucagcgaaaagucuagacucggcuaugagacauuuaaagugaucgaggggugguccaacccuaagagcaaacugcagauuaaucggcaggucaucguggaucgcggaaacagaucuggcuacuccggcauuuucagcgucgaagggaaguccuguaucaaucggugcuuuuauguggagcugauuagaggacgcaaggaagagaccgaaguucucuggaccucuaacagcaucguggucuucuguggcacauccgggaccuacggaacaggcucuuggcccgacggggccaauauuaaccugaugccuaucuga

SEQ ID NO: 200935 - RNA, 1413 nt, Artificial Sequence
  derived and/or modified sequence opt5 from neuraminidase__InfluenzaA__ADA71175
augaaccccaaucagaagaucauuaccaucggcagcauuuccaucgccauugggaucaucucucugaugcuccaaauuggaaacaucauuagcaucugggcuucccacucuauucagaucggcagccagaauaacacagggauuugcaaucagagaaucaucacguacgagaacuccaccugggugaaucauacauaugugaacauuaauaacaccaaaguuguggccggagaagacaagacaucugugacccuggcgggcaauagcucccuuuguagcaucucugggugggcuauuaacacaaaagauaauuccauccggauuggaagcaagggcgacgucuucgugauccgcgagccuuuuaucucuugcucccaccuggaauguagaaccuucuuucucacgcaaggcgcccugcuuaacgauaaacauagcaaugggaccguuaaggaccggucuccguaccgcgcccugauguccugcccccucggagaggcuccuagccccuauaacuccaaguucgaaucuguggccuggagcgcuuccgccugucacgauggcaugggguggcugacaauuggaaucagcggcccugacaacggggcggucgccgugcugaaauacaauggaauuaucaccggcacaauuaagucuuggaaaaagcagauccucagaacccaggaguccgagugcguuuguaugaacggcagcugcuuuacgaucaugacagaugggcccucuaauaaagcugccagcuauaagauuuucaagaucgaaaaaggaaaggugaccaaauccauugagcugaacgcuccuaauuuuuacuaugaagaguguucuugcuacccggacacaggcaucgucaugugugugugccgggauaacuggcaugggagcaaucgccccuggguguccuucaaccagaaucuugacuaccaaauuggauauaucugcagcggcgucuuuggggauaacccuagacccgaggacggagaaggcucuuguaauccuguuaccguggauggcgccaacggggugaagggauucuccuacaaauauggcaauggggucuggauuggacggaccaagagcaaccgccugagaaaaggcuuugagaugaucugggaccccaauggguggacaaacacggacucugauuucuccgugaagcaggacguuguggcgaucaccgauuggagcggcuacuccggaucuuuuguccagcacccggaacucacaggccuggacugcauucggccuuguuucuggguggagcuuguucgcgggcugcccagagaaaacaccacaaucuggaccagcggauccucuauuagcuucugcggcgucaauuccgauacggccaacuggagcuggccugacggggcugagcuccccuuuacaaucgauaaguga

SEQ ID NO: 200936 - RNA, 1413 nt, Artificial Sequence; identical to SEQ ID NO: 200485
  derived and/or modified sequence opt5 from neuraminidase__InfluenzaA__ADA71177

SEQ ID NO: 200937 - RNA, 1410 nt, Artificial Sequence
  derived and/or modified sequence opt5 from neuraminidase__InfluenzaA__ADA71193
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaagucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 200938 - RNA, 1410 nt, Artificial Sequence
  derived and/or modified sequence opt5 from neuraminidase__InfluenzaA__ADA79589
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaucuagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaagucccgcuuugaaucuguugccuggagcgcuuccgccugccacgacggaauuaacuggcugaccaucggcaucagcgggccugauaacggagcuguggccguccugaaguauaauggcauuaucacagacaccauuaaaucuuggagaaacaauauccuccggacacaagaguccgagugugcgugcgugaacgggagcuguuucaccgugaugacggauggaccgucugacggccaggccagcuacaagauuuuucgcaucgaaaaaggcaagaucgucaaauccguugagaugaaugcucccaacuaucauuacgaagagugcucuuguuacccugauagcuccgagauuacaugcgugugcagagacaauuggcacgggagcaaccggcccugggugucuuucaaucagaaccuggaauaucagaucggauacauuuguuccggcaucuuuggggauaauccucgccccaacgacaagaccggaagcugcggcccggucucuuccaauggggccaacggagugaagggcuucagcuuuaaauauggcaaugggguuuggauuggaagaacaaaguccaucucuagccggaacggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuaauucugacacagugggcugguccuggcccgauggggcugagcugccuuucaccaucgacaaauga

SEQ ID NO: 200939 - RNA, 1410 nt, Artificial Sequence
  derived and/or modified sequence opt5 from neuraminidase__InfluenzaA__ADA79599
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaaguuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 200940 - RNA, 1410 nt, Artificial Sequence; identical to SEQ ID NO: 200939
  derived and/or modified sequence opt5 from neuraminidase__InfluenzaA__ADA79609

SEQ ID NO: 200941 - RNA, 1410 nt, Artificial Sequence
  derived and/or modified sequence opt5 from neuraminidase__InfluenzaA__ADA79619
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcguggcguccgugaaacuugcuggaaauucuagccugugcccugucuccggcugggccaucuacagcaaggacaacucuaucagaauuggguccaaaggagauguguuuguuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccgucgcuuggucugccagcgcuugccacgacggaaucaauuggcugaccaucggcauuuccgggccugauaacggagccguggcgguucugaaguauaauggcaucauuacagacaccaucaagagcuggagaaacaauauucuccggacacaagagucugagugugccugcgugaacggguccuguuucaccgucaugacggauggaccgagcgacggccaggcuucuuacaaaaucuuucgcaucgaaaagggcaaaauugucaagagcguggagaugaaugcccccaacuaucauuacgaagagugcuccuguuacccugauucuagcgagaucacaugcgugugcagagacaauuggcacggguccaaccggcccuggguuagcuucaaucagaaccuggaauaucagauuggauacaucuguucuggcauuuuuggggauaauccucgccccaacgacaaaaccggauccugcggcccggugagcucuaauggggcuaacggagugaagggcuucuccuuuaaguauggcaacggggucuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguucagcaucccgagcuuacaggacuggauuguauucgcccuugcuucuggguggaacucaucagaggccggcccaaagagaacacgauuuggaccuccgggagcucuaucuccuuuuguggagucaauagcgacacagugggcuggucuuggcccgauggggccgagcugccuuucaccaucgacaaguga

SEQ ID NO: 200942 - RNA, 1410 nt, Artificial Sequence; identical to SEQ ID NO: 199762
  derived and/or modified sequence opt5 from neuraminidase__InfluenzaA__ADA81211

SEQ ID NO: 200943 - RNA, 1410 nt, Artificial Sequence
  derived and/or modified sequence opt5 from neuraminidase__InfluenzaA__ADA83035
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugcuccaccuuuuuccugacacagggcgcccuucugaaugacaagcauagcaacggcaccauuaaagaucgcucuccuuauagaacgcucauguccugucccaucggggaggugccuagccccuacaacucccgguuugaaucuguugccuggagcgcuuccgccugccacgacggaauuaauuggcugaccaucggcaucagcgggccugauaacggagcuguggccguccugaaguauaauggcauuaucacagacaccauuaagucuuggcgcaacaauauccucagaacacaagaguccgagugugcgugcgugaacgggagcuguuucaccgugaugacggauggaccgucugacggccaggccagcuacaaaauuuuucggaucgaaaagggcaaaaucgucaaguccguugagaugaaugcucccaacuaucauuacgaagagugcucuuguuacccugauagcuccgagauuacaugcgugugccgcgacaauuggcacgggagcaacagacccugggugucuuucaaucagaaccuggaauaucagaucggauacauuuguuccggcaucuuuggggauaauccucggcccaacgacaaaaccggaagcugcggcccggucucuuccaauggggccaacggagugaagggcuucagcuuuaaguauggcaacgggguuuggauuggacgcacaaaauccaucucuagcagaaauggcuucgagaugauuugggauccuaacggguggaccggaaccgacaauaacuuuuccaucaagcaagacaucgugggcauuaaugaauggucuggguacagcggcuccuucguccagcaucccgagcuuacaggacuggauuguauccggccuugcuucuggguggaacucauucgcggcagacccaaagagaacacgaucuggaccagcgggucuuccauuagcuuuuguggaguuaauucugacacagugggcugguccuggcccgauggggcugagcugccuuucaccaucgacaaguga

SEQ ID NO: 200944 - RNA, 1410 nt, Artificial Sequence
  derived and/or modified sequence opt5 from neuraminidase__InfluenzaA__ADA83037
augaaccccaaucagaagaucauuaccaucggcagcgugugcaugacaauugggauggccaaccugauccuccaaauuggaaauaucaucuccauuuggaucucucacagcauucagcugggcaaccaggaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaauggcaccauuaaagacagaagcccuuaucggacgcucaugucuugucccaucggggaggugccuucccccuacaacagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaaguuuagcaucaaacaagauaucgugggcauuaaugaaugguccggguacucuggcagcuucguccagcaucccgagcuuacaggacuggacuguauccgcccuugcuucuggguggaacucauuagaggccggcccaaggagaacacgaucuggaccuccgggagcucuauuuccuuuuguggaguuaauagcgauacagugggcuggucuuggcccgacggggcugagcugccuuucaccaucgauaaauga

SEQ ID NO: 200945 - RNA, 1410 nt, Artificial Sequence; identical to SEQ ID NO: 199762
  derived and/or modified sequence opt5 from neuraminidase__InfluenzaA__ADA83588

SEQ ID NO: 200946 - RNA, 1410 nt, Artificial Sequence; identical to SEQ ID NO: 199762
  derived and/or modified sequence opt5 from neuraminidase__InfluenzaA__ADA83592

SEQ ID NO: 200947 - RNA, 1410 nt, Artificial Sequence; identical to SEQ ID NO: 199762
  derived and/or modified sequence opt5 from neuraminidase__InfluenzaA__ADA83596

SEQ ID NO: 200948 - RNA, 1410 nt, Artificial Sequence; identical to SEQ ID NO: 199762
  derived and/or modified sequence opt5 from neuraminidase__InfluenzaA__ADA83600

SEQ ID NO: 200949 - RNA, 1410 nt, Artificial Sequence; identical to SEQ ID NO: 199762
  derived and/or modified sequence opt5 from neuraminidase__InfluenzaA__ADA83604

SEQ ID NO: 200950 - RNA, 1410 nt, Artificial Sequence; identical to SEQ ID NO: 199762
  derived and/or modified sequence opt5 from neuraminidase__InfluenzaA__ADA83608

SEQ ID NO: 200951 - RNA, 1410 nt, Artificial Sequence; identical to SEQ ID NO: 199762
  derived and/or modified sequence opt5 from neuraminidase__InfluenzaA__ADA83612

SEQ ID NO: 200952 - RNA, 1410 nt, Artificial Sequence; identical to SEQ ID NO: 200116
  derived and/or modified sequence opt5 from neuraminidase__InfluenzaA__ADA83616

SEQ ID NO: 200953 - RNA, 1410 nt, Artificial Sequence; identical to SEQ ID NO: 199762
  derived and/or modified sequence opt5 from neuraminidase__InfluenzaA__ADA83624

SEQ ID NO: 200954 - RNA, 1410 nt, Artificial Sequence; identical to SEQ ID NO: 199762
  derived and/or modified sequence opt5 from neuraminidase__InfluenzaA__ADA83630

SEQ ID NO: 200955 - RNA, 1410 nt, Artificial Sequence; identical to SEQ ID NO: 199762
  derived and/or modified sequence opt5 from neuraminidase__InfluenzaA__ADA83634

SEQ ID NO: 200956 - RNA, 1410 nt, Artificial Sequence; identical to SEQ ID NO: 199762
  derived and/or modified sequence opt5 from neuraminidase__InfluenzaA__ADA83638

SEQ ID NO: 200957 - RNA, 1410 nt, Artificial Sequence; identical to SEQ ID NO: 199762
  derived and/or modified sequence opt5 from neuraminidase__InfluenzaA__ADA83642

SEQ ID NO: 200958 - RNA, 1410 nt, Artificial Sequence; identical to SEQ ID NO: 199762
  derived and/or modified sequence opt5 from neuraminidase__InfluenzaA__ADA83649

SEQ ID NO: 200959 - RNA, 1410 nt, Artificial Sequence; identical to SEQ ID NO: 199762
  derived and/or modified sequence opt5 from neuraminidase__InfluenzaA__ADA83653

SEQ ID NO: 200960 - RNA, 1410 nt, Artificial Sequence; identical to SEQ ID NO: 199762
  derived and/or modified sequence opt5 from neuraminidase__InfluenzaA__ADA83657

SEQ ID NO: 200961 - RNA, 1410 nt, Artificial Sequence; identical to SEQ ID NO: 199762
  derived and/or modified sequence opt5 from neuraminidase__InfluenzaA__ADA83661

SEQ ID NO: 200962 - RNA, 1410 nt, Artificial Sequence; identical to SEQ ID NO: 199762
  derived and/or modified sequence opt5 from neuraminidase__InfluenzaA__ADA83669

SEQ ID NO: 200963 - RNA, 1410 nt, Artificial Sequence; identical to SEQ ID NO: 199762
  derived and/or modified sequence opt5 from neuraminidase__InfluenzaA__ADA83673

SEQ ID NO: 200964 - RNA, 1410 nt, Artificial Sequence; identical to SEQ ID NO: 199762
  derived and/or modified sequence opt5 from neuraminidase__InfluenzaA__ADA83677

SEQ ID NO: 200965 - RNA, 1410 nt, Artificial Sequence; identical to SEQ ID NO: 199762
  derived and/or modified sequence opt5 from neuraminidase__InfluenzaA__ADA83681

SEQ ID NO: 200966 - RNA, 1410 nt, Artificial Sequence; identical to SEQ ID NO: 199762
  derived and/or modified sequence opt5 from neuraminidase__InfluenzaA__ADA83685

SEQ ID NO: 200967 - RNA, 1410 nt, Artificial Sequence; identical to SEQ ID NO: 199762
  derived and/or modified sequence opt5 from neuraminidase__InfluenzaA__ADA86069

SEQ ID NO: 200968 - RNA, 1410 nt, Artificial Sequence; identical to SEQ ID NO: 199762
  derived and/or modified sequence opt5 from neuraminidase__InfluenzaA__ADB27973

SEQ ID NO: 200969 - RNA, 1410 nt, Artificial Sequence; identical to SEQ ID NO: 199762
  derived and/or modified sequence opt5 from neuraminidase__InfluenzaA__ADB27983

SEQ ID NO: 200970 - RNA, 1410 nt, Artificial Sequence
  derived and/or modified sequence opt5 from neuraminidase__InfluenzaA__ADB66693
augaaccccaaucagaagaucauuaccaucggcagcgugugcaugacaauugggauggccaaccugauccuccaaauuggaaauaucaucuccauuuggaucauucacucuauccagcugggcaaccagaaucagauugagacguguaaccaaagcgucaucaccuacgaaaauaacacauggguuaaucagaccuaugugaacauuuccaauacaaacuucgcugccgggcagucuguggucagcgugaaacuugcgggaaauuccucucugugcccuguuagcggcugggcuaucuacuccaaggacaacagcaucagaauugggucuaaaggagauguguuugucauccgggagccguucauuuccuguagcccccucgaaugccgcaccuuuuuccugacacagggcgcccuucugaaugacaagcauucuaacggcaccaucaaagauagauccccuuaucggacgcucaugagcugucccauuggggaggugccuucucccuacaacucccgcuuugaaagcguugccugguccgcuucugccugccacgacggaaucaauuggcugaccaucggcauuagcgggccugauaacggagcuguggccguccugaaguauaauggcaucauuacagacaccaucaaguccuggagaaacaauauucuccggacacaagagagcgagugugcgugcgugaacgggucuuguuucaccgugaugacggauggaccguccgacggccaggccagcuacaaaaucuuucgcaucgaaaagggcaaaauugucaagucuguugagaugaaugcucccaacuaucauuacgaagagugcagcuguuacccugauuccucugagaucacaugcgugugcagagacaauuggcacgggagcaaccggcccuggguguccuucaaucagaaccuggaauaucagauuggauacaucuguagcggcauuuuuggggauaauccucgccccaacgacaaaaccggaucuugcggcccggucuccagcaauggggccaacggagugaagggcuucucuuuuaaguauggcaacgggguuuggaucggaagaacaaaauccauuagcucccggaauggcuucgagaugaucugggauccuaacggguggaccggaaccgacaauaacuuuucuaucaagcaagacauugugggcaucaaugaauggagcggguacuccggcucuuucguccagcaucccgagcuuacaggacuggauuguauucgcccuugcuucuggguggaacucaucagaggccggcccaaagagaacacgauuuggaccagcggguccagcaucucuuuuuguggaguuaauuccgacacagugggcuggagcuggcccgauggggcugagcugccuuucaccaucgacaaguga

SEQ ID NO: 200971 - RNA, 1410 nt, Artificial Sequence; identical to SEQ ID NO: 199762
  derived and/or modified sequence opt5 from neuraminidase__InfluenzaA__ADB66695

SEQ ID NO: 200972 - RNA, 1410 nt, Artificial Sequence; identical to SEQ ID NO: 199762
  derived and/or modified sequence opt5 from neuraminidase__InfluenzaA__ADB66696

SEQ ID NO: 200973 - RNA, 1410 nt, Artificial Sequence
  derived and/or modified sequence opt5 from neuraminidase__InfluenzaA__ADB66697
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccaucggcauuuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacgaacaggccucuuacaaaaucuuucgcaucgagaagggcaaaauugucaagagcguugaaaugaaugcucccaacuaucauuacgaggagugcuccuguuacccugauucuagcgaaaucacaugcgugugcagagacaauuggcacggcuccaaccggcccugggugagcuucaaucagaaccuggaguaucgcauuggguacaucuguucuggaauuuuuggcgauaauccuagacccaacgacaaaaccggguccugcggaccggucagcucuaauggcgccaacggggugaagggauucuccuuuaaguauggcaacggcguuuggaucgggcggacaaaaagcauuuccucucgcaauggauucgaaaugaucugggauccuaacggcuggaccgggaccgacaauaacuuuagcaucaagcaggacauugugggaauccaugagugguccggcuacucugggagcuucguccaacaccccgaacuuacaggccuggauuguauuagaccuugcuucuggguggagcucauccggggacgccccaaagagaauacgauuuggaccuccggcagcucuaucuccuuuugugggguuaacagcgacacagugggauggucuuggcccgauggcgcugaacugccuuucaccaucgacaaguga

SEQ ID NO: 200974 - RNA, 1410 nt, Artificial Sequence; identical to SEQ ID NO: 200937
  derived and/or modified sequence opt5 from neuraminidase__InfluenzaA__ADB81401

SEQ ID NO: 200975 - RNA, 1410 nt, Artificial Sequence; identical to SEQ ID NO: 200780
  derived and/or modified sequence opt5 from neuraminidase__InfluenzaA__ADB81421

SEQ ID NO: 200976 - RNA, 1410 nt, Artificial Sequence; identical to SEQ ID NO: 200116
  derived and/or modified sequence opt5 from neuraminidase__InfluenzaA__ADB81431

SEQ ID NO: 200977 - RNA, 1410 nt, Artificial Sequence; identical to SEQ ID NO: 199762
  derived and/or modified sequence opt5 from neuraminidase__InfluenzaA__ADB81441

SEQ ID NO: 200978 - RNA, 1410 nt, Artificial Sequence
  derived and/or modified sequence opt5 from neuraminidase__InfluenzaA__ADB81451
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugugugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaaguuuagcaucaaacaagacaucgucggcauuaacgaaugguccggguacucuggcagcuucgugcagcaucccgagcuuacaggacuggauuguauccgcccuugcuucuggguugaacucauuagaggccggcccaaggagaauacgaucuggaccuccgggagcucuauuuccuuuuguggagugaacagcgacacagucggcuggucuuggcccgauggggccgagcugccuuucaccaucgacaaauga

SEQ ID NO: 200979 - RNA, 1410 nt, Artificial Sequence; identical to SEQ ID NO: 200939
  derived and/or modified sequence opt5 from neuraminidase__InfluenzaA__ADB81461

SEQ ID NO: 200980 - RNA, 1410 nt, Artificial Sequence; identical to SEQ ID NO: 200939
  derived and/or modified sequence opt5 from neuraminidase__InfluenzaA__ADB82942

SEQ ID NO: 200981 - RNA, 1410 nt, Artificial Sequence; identical to SEQ ID NO: 199917
  derived and/or modified sequence opt5 from neuraminidase__InfluenzaA__ADB82945

SEQ ID NO: 200982 - RNA, 1410 nt, Artificial Sequence; identical to SEQ ID NO: 199762
  derived and/or modified sequence opt5 from neuraminidase__InfluenzaA__ADB89132

SEQ ID NO: 200983 - RNA, 1410 nt, Artificial Sequence; identical to SEQ ID NO: 200345
  derived and/or modified sequence opt5 from neuraminidase__InfluenzaA__ADB89142

SEQ ID NO: 200984 - RNA, 1410 nt, Artificial Sequence; identical to SEQ ID NO: 199762
  derived and/or modified sequence opt5 from neuraminidase__InfluenzaA__ADB89224

SEQ ID NO: 200985 - RNA, 1410 nt, Artificial Sequence
  derived and/or modified sequence opt5 from neuraminidase__InfluenzaA__ADB89234
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucugucagaaucggguccaaaggagauguguuuguuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccgucgcuuggucugccagcgcuugccacgacggaaucaauuggcugaccauuggcaucuccgggccugauaacggagccguggcugugcugaaguauaauggcaucauuacagacaccaucaagagcuggagaaacaauauucuccggacacaagagucugagugugccugcgucaacggguccuguuucaccguuaugacggauggaccgagcaauggccaggcgucuuacaaaaucuuucgcauugaaaagggcaaaaucgucaagagcguggagaugaacgcccccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccgguuagcucuaacggggcuaacggagugaagggcuucuccuuuaaguauggcaauggggucuggaucggaagaacaaaaagcauuuccucucggaacggcuucgagaugaucugggacccuaauggguggaccggaaccgauaacaauuuuagcauuaagcaagacaucgugggcaucaacgaaugguccggguacucuggcagcuucguucagcaucccgagcuuacaggacuggacuguauucgcccuugcuucuggguggaacucaucagaggccggcccaaagagaauacgauuuggaccuccgggagcucuaucuccuuuuguggagucaacagcgauacagugggcuggucuuggcccgacggggccgagcugccuuucaccauugauaaguga

SEQ ID NO: 200986 - RNA, 1410 nt, Artificial Sequence; identical to SEQ ID NO: 199752
  derived and/or modified sequence opt5 from neuraminidase__InfluenzaA__ADB89244

SEQ ID NO: 200987 - RNA, 1410 nt, Artificial Sequence; identical to SEQ ID NO: 199762
  derived and/or modified sequence opt5 from neuraminidase__InfluenzaA__ADB89264

SEQ ID NO: 200988 - RNA, 1410 nt, Artificial Sequence; identical to SEQ ID NO: 200732
  derived and/or modified sequence opt5 from neuraminidase__InfluenzaA__ADB89274

SEQ ID NO: 200989 - RNA, 1410 nt, Artificial Sequence; identical to SEQ ID NO: 199917
  derived and/or modified sequence opt5 from neuraminidase__InfluenzaA__ADB89284

SEQ ID NO: 200990 - RNA, 1410 nt, Artificial Sequence; identical to SEQ ID NO: 199762
  derived and/or modified sequence opt5 from neuraminidase__InfluenzaA__ADB89294

SEQ ID NO: 200991 - RNA, 1410 nt, Artificial Sequence; identical to SEQ ID NO: 199762
  derived and/or modified sequence opt5 from neuraminidase__InfluenzaA__ADB89304

SEQ ID NO: 200992 - RNA, 1410 nt, Artificial Sequence; identical to SEQ ID NO: 199762
  derived and/or modified sequence opt5 from neuraminidase__InfluenzaA__ADB89314

SEQ ID NO: 200993 - RNA, 1410 nt, Artificial Sequence; identical to SEQ ID NO: 199762
  derived and/or modified sequence opt5 from neuraminidase__InfluenzaA__ADB89324

SEQ ID NO: 200994 - RNA, 1410 nt, Artificial Sequence; identical to SEQ ID NO: 199762
  derived and/or modified sequence opt5 from neuraminidase__InfluenzaA__ADB89334

SEQ ID NO: 200995 - RNA, 1410 nt, Artificial Sequence; identical to SEQ ID NO: 199762
  derived and/or modified sequence opt5 from neuraminidase__InfluenzaA__ADB89344

SEQ ID NO: 200996 - RNA, 1410 nt, Artificial Sequence; identical to SEQ ID NO: 199762
  derived and/or modified sequence opt5 from neuraminidase__InfluenzaA__ADB89364

SEQ ID NO: 200997 - RNA, 1410 nt, Artificial Sequence; identical to SEQ ID NO: 199762
  derived and/or modified sequence opt5 from neuraminidase__InfluenzaA__ADB89374

SEQ ID NO: 200998 - RNA, 1410 nt, Artificial Sequence; identical to SEQ ID NO: 199762
  derived and/or modified sequence opt5 from neuraminidase__InfluenzaA__ADB89384

SEQ ID NO: 200999 - RNA, 1410 nt, Artificial Sequence; identical to SEQ ID NO: 199762
  derived and/or modified sequence opt5 from neuraminidase__InfluenzaA__ADB89394

SEQ ID NO: 201000 - RNA, 1410 nt, Artificial Sequence
  derived and/or modified sequence opt5 from neuraminidase__InfluenzaA__ADB89404
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacucuauucuccggacacaagaguccgagugugcgugcgugaaugggagcuguuucaccgucaugacggauggaccgucuaacggccaggccagcuacaaaaucuuucgcauugaaaagggcaaaaucguuaaguccguggagaugaaugcucccaacuaucauuacgaagagugcucuuguuacccugacagcuccgagaucacaugcgugugcagagauaauuggcacgggagcaaccggcccugggucucuuucaaucagaaccuggaauaucagauuggauacaucuguuccggcauuuuuggggacaauccucgccccaacgauaaaaccggaagcugcggcccggugucuuccaauggggccaacggaguuaagggcuucagcuuuaaguauggcaacgggguguggaucggaagaacaaaauccauuucuagccggaauggcuucgagaugaucugggacccuaacggguggaccggaaccgauaauaacuuuuccauuaagcaagacaucgucggcaucaaugaauggucuggguacagcggcuccuucgugcagcaucccgagcuuacaggacuggacuguauucgcccuugcuucuggguugaacucaucagaggccggcccaaagagaacacgauuuggaccagcgggucuuccaucagcuuuuguggagucaauucugauacagugggcugguccuggcccgacggggcugagcugccuuucaccauugauaaguga

SEQ ID NO: 201001 - RNA, 1410 nt, Artificial Sequence; identical to SEQ ID NO: 199762
  derived and/or modified sequence opt5 from neuraminidase__InfluenzaA__ADB89414

SEQ ID NO: 201002 - RNA, 1410 nt, Artificial Sequence; identical to SEQ ID NO: 199762
  derived and/or modified sequence opt5 from neuraminidase__InfluenzaA__ADB89424

SEQ ID NO: 201003 - RNA, 1410 nt, Artificial Sequence; identical to SEQ ID NO: 199762
  derived and/or modified sequence opt5 from neuraminidase__InfluenzaA__ADB89434

SEQ ID NO: 201004 - RNA, 1410 nt, Artificial Sequence; identical to SEQ ID NO: 199762
  derived and/or modified sequence opt5 from neuraminidase__InfluenzaA__ADB89444

SEQ ID NO: 201005 - RNA, 1410 nt, Artificial Sequence
  derived and/or modified sequence opt5 from neuraminidase__InfluenzaA__ADB89454
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgaaugacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 201006 - RNA, 1410 nt, Artificial Sequence; identical to SEQ ID NO: 199762
  derived and/or modified sequence opt5 from neuraminidase__InfluenzaA__ADB89464

SEQ ID NO: 201007 - RNA, 1410 nt, Artificial Sequence; identical to SEQ ID NO: 199762
  derived and/or modified sequence opt5 from neuraminidase__InfluenzaA__ADB89484

SEQ ID NO: 201008 - RNA, 1410 nt, Artificial Sequence; identical to SEQ ID NO: 199762
  derived and/or modified sequence opt5 from neuraminidase__InfluenzaA__ADB89494

SEQ ID NO: 201009 - RNA, 1410 nt, Artificial Sequence; identical to SEQ ID NO: 199752
  derived and/or modified sequence opt5 from neuraminidase__InfluenzaA__ADB89504

SEQ ID NO: 201010 - RNA, 1410 nt, Artificial Sequence; identical to SEQ ID NO: 199762
  derived and/or modified sequence opt5 from neuraminidase__InfluenzaA__ADB89514

SEQ ID NO: 201011 - RNA, 1410 nt, Artificial Sequence; identical to SEQ ID NO: 199762
  derived and/or modified sequence opt5 from neuraminidase__InfluenzaA__ADB89524

SEQ ID NO: 201012 - RNA, 1410 nt, Artificial Sequence
  derived and/or modified sequence opt5 from neuraminidase__InfluenzaA__ADB89544
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucuccuggaaugccgcaccuuuuuccuuacacagggcgcccugcucaaugacaagcauuccaacggcaccauuaaagauagaagccccuaucggacgcugaugucuuguccuaucggggaggugcccuccccuuacaacagccgcuuugaauccguugccuggucugcuagcgccugccacgacggaauuaauuggcugaccaucggcaucuccgggcccgauaacggagcuguggccguccucaaguauaauggcauuaucacagacaccauuaagagcuggagaaacaauauccugcggacacaagagucugagugugcgugcgugaacggguccuguuucaccgugaugacggauggaccuagcgacggccaggccucuuacaaaauuuuucgcaucgaaaagggcaaaaucgucaagagcguugagaugaaugcuccgaacuaucauuacgaagagugcuccuguuaccccgauucuagcgagauuacaugcgugugcagagacaauuggcacggguccaaccggccuugggugagcuucaaucagaaccuugaauaucagaucggauacauuuguucuggcaucuuuggggauaauccccgcccuaacgacaaaaccggauccugcggccccgucagcucuaauggggccaacggagugaagggcuucuccuuuaaguauggcaacgggguuuggauuggaagaacaaaaagcaucuccucucggaauggcuucgagaugauuugggauccgaacggguggaccggaaccgacaauaacuuuagcaucaagcaagacaucgugggcauuaaugaaugguccggguacucuggcagcuucguccagcauccugagcugacaggacucgauuguauccgccccugcuucuggguggaacugauuagaggccggccuaaagagaacacgaucuggaccuccgggagcucuauuuccuuuuguggaguuaauagcgacacagugggcuggucuuggcccgauggggcugagcuucccuucaccaucgacaaguga

SEQ ID NO: 201013 - RNA, 1410 nt, Artificial Sequence; identical to SEQ ID NO: 199762
  derived and/or modified sequence opt5 from neuraminidase__InfluenzaA__ADB89564

SEQ ID NO: 201014 - RNA, 1410 nt, Artificial Sequence; identical to SEQ ID NO: 199762
  derived and/or modified sequence opt5 from neuraminidase__InfluenzaA__ADB89574

SEQ ID NO: 201015 - RNA, 1410 nt, Artificial Sequence; identical to SEQ ID NO: 199762
  derived and/or modified sequence opt5 from neuraminidase__InfluenzaA__ADB89594

SEQ ID NO: 201016 - RNA, 1410 nt, Artificial Sequence; identical to SEQ ID NO: 199762
  derived and/or modified sequence opt5 from neuraminidase__InfluenzaA__ADB89604

SEQ ID NO: 201017 - RNA, 1410 nt, Artificial Sequence
  derived and/or modified sequence opt5 from neuraminidase__InfluenzaA__ADB89614
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggauuuggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201018 - RNA, 1410 nt, Artificial Sequence; identical to SEQ ID NO: 199762
  derived and/or modified sequence opt5 from neuraminidase__InfluenzaA__ADB89624

SEQ ID NO: 201019 - RNA, 1410 nt, Artificial Sequence; identical to SEQ ID NO: 199762
  derived and/or modified sequence opt5 from neuraminidase__InfluenzaA__ADB89634

SEQ ID NO: 201020 - RNA, 1410 nt, Artificial Sequence; identical to SEQ ID NO: 199762
  derived and/or modified sequence opt5 from neuraminidase__InfluenzaA__ADB89644

SEQ ID NO: 201021 - RNA, 1410 nt, Artificial Sequence; identical to SEQ ID NO: 200780
  derived and/or modified sequence opt5 from neuraminidase__InfluenzaA__ADB89664

SEQ ID NO: 201022 - RNA, 1410 nt, Artificial Sequence; identical to SEQ ID NO: 199762
  derived and/or modified sequence opt5 from neuraminidase__InfluenzaA__ADB89674

SEQ ID NO: 201023 - RNA, 1410 nt, Artificial Sequence; identical to SEQ ID NO: 199762
  derived and/or modified sequence opt5 from neuraminidase__InfluenzaA__ADB89684

SEQ ID NO: 201024 - RNA, 1410 nt, Artificial Sequence
  derived and/or modified sequence opt5 from neuraminidase__InfluenzaA__ADB89694
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuacaaucaagcaagacaucgugggcauuaaugaauggagcggguacuccggcucuuucguccagcaucccgagcuuacgggacuggauuguauccgcccuugcuucuggguggaacucauuagaggccggcccaaagagaacaccaucuggacaagcggguccagcauuucuuuuuguggaguuaauuccgacaccgugggcuggagcuggcccgauggggcugagcugccuuucacaaucgacaaguga

SEQ ID NO: 201025 - RNA, 1410 nt, Artificial Sequence; identical to SEQ ID NO: 199762
  derived and/or modified sequence opt5 from neuraminidase__InfluenzaA__ADB89704

SEQ ID NO: 201026 - RNA, 1410 nt, Artificial Sequence; identical to SEQ ID NO: 199762
  derived and/or modified sequence opt5 from neuraminidase__InfluenzaA__ADB89714

SEQ ID NO: 201027 - RNA, 1410 nt, Artificial Sequence; identical to SEQ ID NO: 199623
  derived and/or modified sequence opt5 from neuraminidase__InfluenzaA__ADB89724

SEQ ID NO: 201028 - RNA, 1410 nt, Artificial Sequence; identical to SEQ ID NO: 199623
  derived and/or modified sequence opt5 from neuraminidase__InfluenzaA__ADB89735

SEQ ID NO: 201029 - RNA, 1410 nt, Artificial Sequence; identical to SEQ ID NO: 199762
  derived and/or modified sequence opt5 from neuraminidase__InfluenzaA__ADB90357

SEQ ID NO: 201030 - RNA, 1410 nt, Artificial Sequence; identical to SEQ ID NO: 199762
  derived and/or modified sequence opt5 from neuraminidase__InfluenzaA__ADB90358

SEQ ID NO: 201031 - RNA, 1410 nt, Artificial Sequence
  derived and/or modified sequence opt5 from neuraminidase__InfluenzaA__ADB90359
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucgcauuggauacaucuguucuggcauuuuuggggauaauccuagacccaacgacaaaaccggauccugcggcccggugagcucuaauggggccaacggagucaagggcuucuccuuuaaguauggcaacgggguguggaucggacggacaaaaagcauuuccucucgcaauggcuucgagaugaucugggauccuaacggguggaccggaaccgacaauaacuuuagcaucaagcaggacauuguuggcacaaaugaaugguccggguacucuggcagcuucgugcaacaucccgagcuuacgggacuggauuguaucagaccuugcuucugggucgaacucauucggggccgccccaaagagaacaccaucuggacauccgggagcucuauuuccuuuuguggagugaauagcgacaccguuggcuggucuuggcccgauggggcugagcugccuuucacaaucgacaaguga

SEQ ID NO: 201032 - RNA, 1410 nt, Artificial Sequence; identical to SEQ ID NO: 199762
  derived and/or modified sequence opt5 from neuraminidase__InfluenzaA__ADB90363

SEQ ID NO: 201033 - RNA, 1410 nt, Artificial Sequence; identical to SEQ ID NO: 200939
  derived and/or modified sequence opt5 from neuraminidase__InfluenzaA__ADB90373

SEQ ID NO: 201034 - RNA, 1410 nt, Artificial Sequence; identical to SEQ ID NO: 199762
  derived and/or modified sequence opt5 from neuraminidase__InfluenzaA__ADB98137

SEQ ID NO: 201035 - RNA, 1410 nt, Artificial Sequence; identical to SEQ ID NO: 200116
  derived and/or modified sequence opt5 from neuraminidase__InfluenzaA__ADB98138

SEQ ID NO: 201036 - RNA, 1410 nt, Artificial Sequence; identical to SEQ ID NO: 199762
  derived and/or modified sequence opt5 from neuraminidase__InfluenzaA__ADB98139

SEQ ID NO: 201037 - RNA, 1410 nt, Artificial Sequence; identical to SEQ ID NO: 200116
  derived and/or modified sequence opt5 from neuraminidase__InfluenzaA__ADB98140

SEQ ID NO: 201038 - RNA, 1410 nt, Artificial Sequence; identical to SEQ ID NO: 200116
  derived and/or modified sequence opt5 from neuraminidase__InfluenzaA__ADB98141

SEQ ID NO: 201039 - RNA, 1410 nt, Artificial Sequence; identical to SEQ ID NO: 199762
  derived and/or modified sequence opt5 from neuraminidase__InfluenzaA__ADC32391

SEQ ID NO: 201040 - RNA, 1410 nt, Artificial Sequence; identical to SEQ ID NO: 199762
  derived and/or modified sequence opt5 from neuraminidase__InfluenzaA__ADC32392

SEQ ID NO: 201041 - RNA, 1410 nt, Artificial Sequence; identical to SEQ ID NO: 199762
  derived and/or modified sequence opt5 from neuraminidase__InfluenzaA__ADC32393

SEQ ID NO: 201042 - RNA, 1410 nt, Artificial Sequence; identical to SEQ ID NO: 199762
  derived and/or modified sequence opt5 from neuraminidase__InfluenzaA__ADC32394

SEQ ID NO: 201043 - RNA, 1410 nt, Artificial Sequence; identical to SEQ ID NO: 199762
  derived and/or modified sequence opt5 from neuraminidase__InfluenzaA__ADC32395

SEQ ID NO: 201044 - RNA, 1410 nt, Artificial Sequence; identical to SEQ ID NO: 199762
  derived and/or modified sequence opt5 from neuraminidase__InfluenzaA__ADC32396

SEQ ID NO: 201045 - RNA, 1410 nt, Artificial Sequence; identical to SEQ ID NO: 199762
  derived and/or modified sequence opt5 from neuraminidase__InfluenzaA__ADC32397

SEQ ID NO: 201046 - RNA, 1410 nt, Artificial Sequence; identical to SEQ ID NO: 199762
  derived and/or modified sequence opt5 from neuraminidase__InfluenzaA__ADC32398

SEQ ID NO: 201047 - RNA, 1410 nt, Artificial Sequence; identical to SEQ ID NO: 199762
  derived and/or modified sequence opt5 from neuraminidase__InfluenzaA__ADC32399

SEQ ID NO: 201048 - RNA, 1410 nt, Artificial Sequence; identical to SEQ ID NO: 199762
  derived and/or modified sequence opt5 from neuraminidase__InfluenzaA__ADC32400

SEQ ID NO: 201049 - RNA, 1410 nt, Artificial Sequence; identical to SEQ ID NO: 199762
  derived and/or modified sequence opt5 from neuraminidase__InfluenzaA__ADC32401

SEQ ID NO: 201050 - RNA, 1410 nt, Artificial Sequence
  derived and/or modified sequence opt5 from neuraminidase__InfluenzaA__ADC32404
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccaacggagugaagggcuucuccuuuaaauauggcaacgggguuuggauuggaagaaccaagagcaucuccucucggaauggcuucgagaugauuugggauccuaacggguggacaggaaccgacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacacaaucuggacguccgggagcucuauuuccuuuuguggaguuaauagcgacaccgugggcuggucuuggcccgauggggcugagcugccuuucacaaucgacaaauga

SEQ ID NO: 201051 - RNA, 1410 nt, Artificial Sequence
  derived and/or modified sequence opt5 from neuraminidase__InfluenzaA__ADC32407
augaaccccaagcagaaaaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaagggauccugcggcccggucagcucuaacggggccaauggagugaaaggcuucuccuuuaaguauggcaacgggguuuggauuggaagaaccaaaagcaucuccucucggaacggcuucgagaugauuugggauccuaauggguggacaggaaccgacaacaauuuuagcaucaagcaagacaucgugggcauuaacgaaugguccggguacucuggcagcuucguccagcaucccgagcuuaccggacuggauuguauccgcccuugcuucuggguggaacucauuagaggccggcccaaagagaauacaaucuggacguccgggagcucuauuuccuuuuguggaguuaacagcgacaccgugggcuggucuuggcccgauggggcugagcugccuuucacaaucgacaaguga

SEQ ID NO: 201052 - RNA, 1410 nt, Artificial Sequence
  derived and/or modified sequence opt5 from neuraminidase__InfluenzaA__ADC34942
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccgggaguggagcaagccucaguguaauauuaccggguucgcccccuuuuccaaagacaacucuauccgccugagcgcgggaggcgauaucugggugacaagagaaccuuaugucuccugcgacccggauaaguguuaccaauucgcucuugggcagggaaccacacugaauaacgugcauucuaaugacauuguucgggaucgcacccccuauagaacgcuccugaugaacgagcugggcgugccuuuucaccucgggacaaagcaggucugcaucgccuggagcuccagcucuugucaugacggaaaagccuggcugcacgugugcguuaccggcgaugacaagaaugcuacagccuccuucauuuacaacggccggcuuguggauagcaucgucucuugguccaaagaaauucugcgcacccaggagagcgagugugugugcaucaaugggaccuguacaguggucaugacggacggaucugcuuccggcaaggccgauaccaaaauccucuuuauugaagaggggaagaucguucauacaagcacccuguccggaucugcgcaacacguggaagagugcagcugcuaucccagauacccuggcgugcggugugucugccgcgacaacuggagaggguccaaccggcccauuguggauaucaauaugaaggacuacagcauuguuucuuccuauguguguagcggacuugucggcgacacaccgcgcaaaaacgauucuagcuccucuggccacugccugaauccuaacaaugaagaagggggacauggcgugaaggggugggccuucgacgauggaaacgacguuuggaugggcagaaccaucagcgagaaacuccgguccggguacgagacguuuaaggugaucgagggauggagcaaucccaacucuaaacugcagauuaaucgccaggucaucguggauagaggcaaccgguccggcuauagcgggauuuucucugucgaaggaaaguccuguaucaauagaugcuuuuacguggagcugauucgcggccggaaagaagagacagagguucucuggaccagcaacuccaucguggucuucugugggaccucuggaacauauggcaccgggagcuggccugacggcgcugauauuaaucugaugcccaucuga

SEQ ID NO: 201053 - RNA, 1410 nt, Artificial Sequence
  derived and/or modified sequence opt5 from neuraminidase__InfluenzaA__ADC39000
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacaacgugggcuggucuuggcccgauggggcugagcugccuuucacaaucgacaaguga

SEQ ID NO: 201054 - RNA, 1410 nt, Artificial Sequence; identical to SEQ ID NO: 199762
  derived and/or modified sequence opt5 from neuraminidase__InfluenzaA__ADC39010

SEQ ID NO: 201055 - RNA, 1413 nt, Artificial Sequence; identical to SEQ ID NO: 199656
  derived and/or modified sequence opt5 from neuraminidase__InfluenzaA__ADC45606

SEQ ID NO: 201056 - RNA, 1413 nt, Artificial Sequence
  derived and/or modified sequence opt5 from neuraminidase__InfluenzaA__ADC45628
augaaccccaaucagaagaucauuaccaucggcagcauuuccaucgccauugggaucaucucucugaugcuccaaaugggaaacauuaucagcauuugggcuucccacucuauccagacaggcagccagaaucauacggggauuugcaaccagagaaucauuaccuacgaaaauuccacaugggugaaccacaccuaugucaauaucaacaauacaaacguuguggccggaaaagacaagaccccugugacacuggucggcaauucuagccuuuguuccaucagcgggugggcgauuuacaccaaagauaacucuauccggauuggauccaagggcgacguguucguuauccgcgagccguuuauuagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccaucggaauuuccggccccgacaacggggccguggcgguucugaaguauaaaggaaucauuacaggcaccaucaagagcuggaaaaagcagauucuccgcacgcaggaaucugagugcguguguaugaacggcuccugcuuuacaaucaugaccgaugggccuagcaauggagccgcuucuuacaagaucuucaaaauugagaagggcaaagucacaaagagcauggaacugaacgccccgaauuuucacuaugaggaauguuccugcuaccccgacaccgggaccgugaugugugugugcagagauaacuggcacggaucuaaucggccuugggucagcuucaaccagaaucuugacuaccaaaucggcuauauuugcuccgggguuuuuggagauaacccccgcccuaaagacagagagggcagcuguaaucccgugacaguggauggcgcuaacggggucaagggauucucuuacaaauauggcaaugggguguggaucggacggacgaaguccaaccgcauuagaaagggcuuugagaugaucugggacccgaauggguggaccaacacagacagcgauuucucuguuaaacaggacauuguggccaucaccgauugguccggcuacagcggauccuuuguccagcauccugaacugacaggccucgacugcauccggcccuguuucuggguggagcugguucgcgggcuuccuagagaaaauaccacgauuuggacaucuggaagcuccaucucuuucugcggcgugaacggggauauugcgaacuggagcuggcccgacggagccgagcugcccuuuaccaucgauaaguga

SEQ ID NO: 201057 - RNA, 1413 nt, Artificial Sequence
  derived and/or modified sequence opt5 from neuraminidase__InfluenzaA__ADC45639
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggucggcaauucuagccuuuguuccauuagcgggugggcgaucuacaccaaagauaacucuauucggaucggauccaagggcgacguguucguuauucgcgagccguuuaucagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccauuggaguguccggccccgacaacggggccguugcggugcugaaguauaaaggaaucauuacaggcaccaucaagagcuggaaaaagcagauucuccgcacgcaggaaucugagugcgucuguaugaacggcuccugcuuuacaaucaugaccgaugggccuagcaauggagccgcuucuuacaagaucuucaaaauugagaagggcaaagugacaaagagcauggaacugaacgccccgaauuuucacuaugaggaauguuccugcuaccccgacaccgggaccgugaugugugucugcagagauaacuggcacggaucuaaucggccuuggguuagcuucaaccagaaucuugacuaccaaaucggcuauauuugcuccgggguguuuggagauaacccccgcccuaaagacagagagggcagcuguaaucccgugacagucgauggcgcuaacggggugaagggauucucuuacaaauauggcaaugggguuuggaucggacggacgaaguccaaccgcauuagaaagggcuuugagaugaucugggacccgaauggguggaccaacacagacagcgauuucucugugaaacaggacauugucgccaucaccgauugguccggcuacagcggauccuuugugcagcauccugaacugacaggccucgacugcauccggcccuguuucuggguugagcuggugcgcgggcuuccuagagaaaauaccacgauuuggacaucuggaagcuccaucucuuucugcggcgucaacggggauauugcgaacuggagcuggcccgacggagccgagcugcccuuuaccaucgauaaguga

SEQ ID NO: 201058 - RNA, 1413 nt, Artificial Sequence; identical to SEQ ID NO: 199656
  derived and/or modified sequence opt5 from neuraminidase__InfluenzaA__ADC45650

SEQ ID NO: 201059 - RNA, 1413 nt, Artificial Sequence; identical to SEQ ID NO: 199656
  derived and/or modified sequence opt5 from neuraminidase__InfluenzaA__ADC45661

SEQ ID NO: 201060 - RNA, 1413 nt, Artificial Sequence
  derived and/or modified sequence opt5 from neuraminidase__InfluenzaA__ADC45683
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggagaggacaaaaccccugugacacuggucggcaauucuagccuuuguuccauuagcgggugggcgaucuacaccaaggauaacucuauucggaucggauccaaaggcgacguguucguuauucgcgagccguuuaucagcugcucucaucuggaauguaagacguucuuucucacccaaggcgcucugcuuaaugauaaacacuccaacgggacagugaaggacagaagccccuaucgggcccugaugucuugcccucucggagaggcccccuccccuuacaauagcaaguucgaauccgucgcuuggucugccagcgcuugucaugauggcaucggguggcugaccauuggaaucuccggccccgacaacggggccguggcgguucugaaauauaagggaauuaucacaggcaccauuaaaagcuggaagaaacagauccuccgcacgcaggagucugagugcguguguaugaacggcuccugcuuuacaaucaugaccgaugggccuagcaauggagccgcuucuuacaagauuuucaagaucgaaaaaggcaaggucacaaaaagcauggagcugaacgccccgaauuuucacuaugaagaguguuccugcuaccccgacaccgggaccgugaugugugugugcagagauaacuggcacggaucuaaucggccuugggucagcuucaaccagaaucuugacuaccaaauuggcuauaucugcuccgggguuuuuggagauaacccccgcccuaaggacagagagggcagcuguaaucccgugacaguggauggcgcuaacggggucaaaggauucucuuacaaguauggcaaugggguguggauuggacggacgaaauccaaccgcaucagaaagggcuuugaaaugauuugggacccgaauggguggaccaacacagacagcgauuucucuguuaagcaggacaucguggccaucaccgauugguccggcuacagcggauccuuuguccagcauccugagcugacaggccucgacugcauucggcccuguuucuggguggaacugguucgcgggcuuccuagagagaauaccacgaucuggacaucuggaagcuccauuucuuucugcggcgugaacggggauaucgcgaacuggagcuggcccgacggagccgaacugcccuuuaccauugauaaauga

SEQ ID NO: 201061 - RNA, 1413 nt, Artificial Sequence
  derived and/or modified sequence opt5 from neuraminidase__InfluenzaA__ADC45705
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaaaaccggucuccguaucgcgcccugauguccugcccccucggagaggcuccuagccccuacaacuccaaguucgaaucuguggccuggagcgcuuccgccugucacgacggcaugggguggcugaccaucggaauuagcggcccugauaauggggcggucgccgugcugaaguauaacggaaucauuacaggcaccaucaaaucuuggaagaaacagauucucagaacgcaggaguccgagugcguuuguaugaauggcagcugcuuuacaaucaugaccgacgggcccucuaacaaggcugccagcuacaaaaucuucaagauugaaaagggaaaagugacaaaguccaucgagcugaaugcuccuaacuuucauuaugaagaguguucuugcuacccggauaccggcauugucaugugugugugccgggacaauuggcacgggagcaaccgccccuggguguccuucaaucagaaccuugauuaccaaaucggauauauuugcagcggcgucuuuggggacaauccuagacccgaggauggagaaggcucuuguaacccuguuaccguggacggcgccaauggggugaaaggauucuccuacaaguaugauaacggcgucuggaucgggcggacaaaaagcaaucgccugagaaagggauuugagaugauuugggaccccaacggcuggacgaacaccgacucugauuucuccgugaaacaggacguuguggcgaucacagauuggagcggguacuccggcucuuuuguccagcacccggaacucaccggacuggacugcauccggccuuguuucuggguggagcuuguucgcggccugcccagagaaaauacaaccauuuggacgagcggguccucuaucagcuucugcggagugaacuccgauacagccaauuggagcuggccugacggcgcugagcuccccuuuaccauugauaaguga

SEQ ID NO: 201062 - RNA, 1413 nt, Artificial Sequence
  derived and/or modified sequence opt5 from neuraminidase__InfluenzaA__ADC45716
augaaccccaaucagaagaucauuaccaucggcagcauuuccaucgccauugggaucaucucucugaugcuccaaauuggaaacaucauuagcaucugggcuucccacucuauucagacaggcagccagaaucauacggggaucugcaaccagagaauuaucaccuacgaaaauuccacaugggugaaccacaccuaugucaauaucaacaauacaaacguuguggccggaaaagacaagaccccugugacacuggucggcaauucuagccuuuguuccauuagcgggugggcgaucuacaccaaagauaacucuauucggaucggauccaagggcgacguguucguuauucgcgagccguuuaucagcugcucucaucuggaguguaaaacguucuuucucacccaaggcgcucugcuuaaugauaagcacuccaacgggacagugaaggacagaagccccuaucgggcccugaugucuugcccucucggagaagcccccuccccuuacaauagcaaauucgaguccgucgcuuggucugccagcgcuugucaugauggcaucggguggcugaccauuggaaucuccggccccgacaacggggccguggcgguucugaaguauaaaggaauuaucacaggcaccauuaagagcuggaaaaagcagauccuccgcacgcaggaaucugagugcguguguaugaacggcuccugcuuuacaaucaugaccgaugggccuagcaauggagccgcuucuuacaagauuuucaaaaucgagaagggcaaagucacaaagagcauggaacugaacgccccgaauuuucacuaugaggaauguuccugcuaccccgacaccgggaccgugaugugugugugcagagauaacuggcacggaucuaaucggccuugggucagcuucaaccagaaucuugacuaccaaauuggcuauaucugcuccgggguuuuuggagauaacccccgcccuaaagacagagagggcagcuguaaucccgugacaguggauggcgcuaacggggucgagggauucucuuacaaguauggcaaugggguguggauuggacggacgaaauccaaccgcaucagaaagggcuuugaaaugauuugggacccgaauggguggaccaacacagacagcgauuucucuguuaagcaggacaucguggccaucaccaauugguccggcuacagcggauccuuuguccagcauccugagcugacaggccucgauugcauucggcccuguuucuggguggaacugguucgcgggcuuccuagagagaacaccacgaucuggacaucuggaagcuccauuucuuucugcggcgugaacggggacaucgcgaauuggagcuggcccgauggagccgaacugcccuuuaccauugacaaauga

SEQ ID NO: 201063 - RNA, 1413 nt, Artificial Sequence
  derived and/or modified sequence opt5 from neuraminidase__InfluenzaA__ADC45738
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacgacaauggcgucuggaucgggcggacaaaaagcaaccgccugagaaagggauuugagaugauuugggaccccaauggcuggacgaacaccgauucugacuucuccgugaaacaggauguuguggcgaucacagacuggagcggguauuccggcucuuuuguccagcacccggaacucaccggacuggauugcauccggccuuguuucuggguggagcuuguucgcggccugcccagagaaaacacaaccauuuggacgagcggguccucuaucagcuucugcggagucaauuccgacacagccaacuggagcuggccugauggcgcugagcuccccuuuaccauugacaaguga

SEQ ID NO: 201064 - RNA, 1413 nt, Artificial Sequence
  derived and/or modified sequence opt5 from neuraminidase__InfluenzaA__ADC45760
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacagccaaagaccggucuccguaucgcgcucugauguccugcccccucggagaggccccuagccccuacaacuccaaguucgaaucuguugcuuggagcgccuccgcgugucacgauggcaugggguggcugaccaucggaauuagcggcccugacaacggggccguggcuguccugaaguauaauggaaucauuacaggcaccaucaaaucuuggaagaaacagauucucagaacgcaggaguccgagugcguguguaugaacggcagcugcuuuacaaucaugaccgaugggcccucuaauaaggccgcuagcuacaaaaucuucaagauugaaaagggaaaaguuacaaaguccaucgagcugaacgccccuaauuuuuauuacgaagaguguucuugcuacccggacaccggcauugugaugugugucugccgggauaacuggcaugggagcaaucgccccuggguguccuucaaccagaaucuugacuaucaaaucggauacauuugcagcggcguguuuggggauaacccuagacccgaggacggagaaggcucuuguaauccugucaccguugauggcgcgaacggggugaaaggauucuccuauaaguacggcaaugggguguggaucggacggacaaaaagcaaccgccugagaaagggcuuugagaugauuugggaccccaauggguggacgaacaccgacucugauuucuccgucaaacaggacgugguugccaucacagauuggagcggcuauuccggaucuuuugugcagcacccggaacucaccggccuggggugcauccggccuuguuucugggucgagcuugugcgcggacugcccagagaaaacacaaccauuuggacgagcggcuccucuaucagcuucugcgggguuaauuccgacacagcuaacuggagcuggccugauggagccgagcuccccuuuaccauugacaaguga

SEQ ID NO: 201065 - RNA, 1413 nt, Artificial Sequence
  derived and/or modified sequence opt5 from neuraminidase__InfluenzaA__ADC45771
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccgaggacggagaaggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccaugaaacaggacgugguugcgaucacagauuggagcggcuauuccggaucuuuugugcagcacccggaacucaccggccuggacugcauccggccuuguuucugggucgagcuugugcgcgggcugcccagagaaaacacaaccauuuggacgagcggauccucuaucagcuucugcggcguuaauuccgauacagccaacuggagcuggccugacggggcugagcuccccuuuaccauugauaaguga

SEQ ID NO: 201066 - RNA, 1413 nt, Artificial Sequence
  derived and/or modified sequence opt5 from neuraminidase__InfluenzaA__ADC45782
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaucggacaguuaaagaccgcucuccguauagagcccugauguccugcccccucggggaggcuccuagccccuacaacuccaaguucgaaucuguggccuggagcgcuuccgccugucacgauggaaugggcuggcugaccaucgggauuagcggaccugacaacggcgcggucgccgugcugaaguauaaugggaucauuacaggaaccaucaaaucuuggaagaaacagauucuccggacgcaggaguccgagugcguuugugugaacggcagcugcuuuacaaucaugaccgauggccccucuaauaaggcugccagcuacaaaaucuucaagauugaaaaggggaaagucacaaaguccaucgagcugaacgcuccuaauuuuuauuacgaagaguguucuugcuacccggacaccggaauugugaugugugugugccgcgauaacuggcauggcagcaauagacccugggucuccuucaaccagaaucuugacuaucaaaucggguacauuugcagcggaguuuuuggcgauaacccucggcccgaggacggggaaggaucuuguaauccugugaccguggauggcgccaacggcgucaaaggguucuccuauaaguacggaaauggcguguggaucgggcgcacaaaaagcaacagacugcggaagggauuugagaugauuugggaccccaauggcuggacgaacaccgacucugauuucuccguuaaacaggacguggucgcgaucacagauuggagcggguauuccggcucuuuugugcagcacccggaacucaccggacuggacugcauccgcccuuguuucuggguugagcuugugagaggccugccccgggaaaacacaaccauuuggacgagcggguccucuaucagcuucugcggagucaauuccgauacagccaacuggagcuggccugacggcgcugagcuccccuuuaccauugauaaguga

SEQ ID NO: 201067 - RNA, 1413 nt, Artificial Sequence
  derived and/or modified sequence opt5 from neuraminidase__InfluenzaA__ADC45804
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaaaucacaaaguccauugagcugaacgcuccuaauuuuuauuacgaagaguguucuugcuacccggacaccggcaucgugaugugugucugccgggauaacuggcaugggagcaaucgccccuggguguccuucaaccagaaucuugacuaucaaauuggauacaucugcagcggcguguuuggggauaacccuagacccgaggacggagaaggcucuuguaauccugucaccguugauggcgccaacggggugaaaggauucuccuauaaguacggcaaugggguguggauuggacggacaaaaagcaaccgccugagaaagggcuuugagaugaucugggaccccaauggguggacgaacaccgacucugauuucuccgucaaacaggacgugguugcgaucacagauuggagcggcuauuccggaucuuuugugcagcacccggaacucaccggccuggacugcauucggccuuguuucugggucgagcuugugcgcgggcugcccagagaaaacacaaccaucuggacgagcggauccucuauuagcuucugcggcguuaauuccgauacagccaacuggagcuggccugacggggcugagcuccccuuuaccaucgauaaguga

SEQ ID NO: 201068 - RNA, 1413 nt, Artificial Sequence
  derived and/or modified sequence opt5 from neuraminidase__InfluenzaA__ADC45815
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccguuaaaucuuggaagaaacagauccucagaacgcaggaguccgagugcguguguaugaacggcagcugcuuuacaauuaugaccgaugggcccucuaauaaggcugccagcuacaaaaucuucaagaucgaaaagggaaaagucacaaaguccauugagcugaacgcuccuaauuuuuauuacgaagaguguucuugcuacccggacaccggcauggugaugugugugugccgggauaacuggcaugggagcaaucgccccugggucuccuucaaccagaaucuugacuaucaaaucggauacauuugcagcggcguuuuuggggauaacccuagacccgaggacggagaaggcucuuguaauccugugaccguggauggcgccaacggggucaaaggauucuccuauaaguacggcaaugggguguggaucggacggacaaaaagcaaccgccugagaaagggcuuugagaugauuugggaccccaauggguggacgaacaccgacucugauuucuccguuaaacaggacguggucgcgaucacagauuggagcggcuauuccggaucuuuugugcagcacccggaacucaccggccuggacugcauucggccuuguuucuggguugagcuugugcgcgggcugcccagagaaaacacaaccaucuggacgagcggauccucuaucagcuucugcggcgucaauuccgauacagccaacuggagcuggccugacggggcugagcuccccuuuaccauugauaaguga

SEQ ID NO: 201069 - RNA, 1413 nt, Artificial Sequence; identical to SEQ ID NO: 200485
  derived and/or modified sequence opt5 from neuraminidase__InfluenzaA__ADC45837

SEQ ID NO: 201070 - RNA, 1413 nt, Artificial Sequence; identical to SEQ ID NO: 200485
  derived and/or modified sequence opt5 from neuraminidase__InfluenzaA__ADC45848

SEQ ID NO: 201071 - RNA, 1410 nt, Artificial Sequence; identical to SEQ ID NO: 199762
  derived and/or modified sequence opt5 from neuraminidase__InfluenzaA__ADC53559

SEQ ID NO: 201072 - RNA, 1410 nt, Artificial Sequence; identical to SEQ ID NO: 199762
  derived and/or modified sequence opt5 from neuraminidase__InfluenzaA__ADD14088

SEQ ID NO: 201073 - RNA, 1410 nt, Artificial Sequence; identical to SEQ ID NO: 199762
  derived and/or modified sequence opt5 from neuraminidase__InfluenzaA__ADD14090

SEQ ID NO: 201074 - RNA, 1410 nt, Artificial Sequence; identical to SEQ ID NO: 199762
  derived and/or modified sequence opt5 from neuraminidase__InfluenzaA__ADD14094

SEQ ID NO: 201075 - RNA, 1410 nt, Artificial Sequence; identical to SEQ ID NO: 199762
  derived and/or modified sequence opt5 from neuraminidase__InfluenzaA__ADD14096

SEQ ID NO: 201076 - RNA, 1410 nt, Artificial Sequence; identical to SEQ ID NO: 199762
  derived and/or modified sequence opt5 from neuraminidase__InfluenzaA__ADD14098

SEQ ID NO: 201077 - RNA, 1410 nt, Artificial Sequence; identical to SEQ ID NO: 199762
  derived and/or modified sequence opt5 from neuraminidase__InfluenzaA__ADD14100

SEQ ID NO: 201078 - RNA, 1410 nt, Artificial Sequence; identical to SEQ ID NO: 199762
  derived and/or modified sequence opt5 from neuraminidase__InfluenzaA__ADD14102

SEQ ID NO: 201079 - RNA, 1410 nt, Artificial Sequence; identical to SEQ ID NO: 199762
  derived and/or modified sequence opt5 from neuraminidase__InfluenzaA__ADD14104

SEQ ID NO: 201080 - RNA, 1410 nt, Artificial Sequence; identical to SEQ ID NO: 199762
  derived and/or modified sequence opt5 from neuraminidase__InfluenzaA__ADD14106

SEQ ID NO: 201081 - RNA, 1410 nt, Artificial Sequence; identical to SEQ ID NO: 199762
  derived and/or modified sequence opt5 from neuraminidase__InfluenzaA__ADD14110

SEQ ID NO: 201082 - RNA, 1410 nt, Artificial Sequence; identical to SEQ ID NO: 199762
  derived and/or modified sequence opt5 from neuraminidase__InfluenzaA__ADD14112

SEQ ID NO: 201083 - RNA, 1410 nt, Artificial Sequence; identical to SEQ ID NO: 200732
  derived and/or modified sequence opt5 from neuraminidase__InfluenzaA__ADD14114

SEQ ID NO: 201084 - RNA, 1410 nt, Artificial Sequence; identical to SEQ ID NO: 199762
  derived and/or modified sequence opt5 from neuraminidase__InfluenzaA__ADD14116

SEQ ID NO: 201085 - RNA, 1410 nt, Artificial Sequence; identical to SEQ ID NO: 199762
  derived and/or modified sequence opt5 from neuraminidase__InfluenzaA__ADD14118

SEQ ID NO: 201086 - RNA, 1410 nt, Artificial Sequence; identical to SEQ ID NO: 199762
  derived and/or modified sequence opt5 from neuraminidase__InfluenzaA__ADD14120

SEQ ID NO: 201087 - RNA, 1410 nt, Artificial Sequence; identical to SEQ ID NO: 199762
  derived and/or modified sequence opt5 from neuraminidase__InfluenzaA__ADD14122

SEQ ID NO: 201088 - RNA, 1410 nt, Artificial Sequence; identical to SEQ ID NO: 199762
  derived and/or modified sequence opt5 from neuraminidase__InfluenzaA__ADD14124

SEQ ID NO: 201089 - RNA, 1410 nt, Artificial Sequence; identical to SEQ ID NO: 200821
  derived and/or modified sequence opt5 from neuraminidase__InfluenzaA__ADD14126

SEQ ID NO: 201090 - RNA, 1410 nt, Artificial Sequence; identical to SEQ ID NO: 199762
  derived and/or modified sequence opt5 from neuraminidase__InfluenzaA__ADD14128

SEQ ID NO: 201091 - RNA, 1410 nt, Artificial Sequence; identical to SEQ ID NO: 199762
  derived and/or modified sequence opt5 from neuraminidase__InfluenzaA__ADD14130

SEQ ID NO: 201092 - RNA, 1410 nt, Artificial Sequence; identical to SEQ ID NO: 199762
  derived and/or modified sequence opt5 from neuraminidase__InfluenzaA__ADD14132

SEQ ID NO: 201093 - RNA, 1410 nt, Artificial Sequence; identical to SEQ ID NO: 199762
  derived and/or modified sequence opt5 from neuraminidase__InfluenzaA__ADD14134

SEQ ID NO: 201094 - RNA, 1410 nt, Artificial Sequence; identical to SEQ ID NO: 199762
  derived and/or modified sequence opt5 from neuraminidase__InfluenzaA__ADD14136

SEQ ID NO: 201095 - RNA, 1410 nt, Artificial Sequence; identical to SEQ ID NO: 199762
  derived and/or modified sequence opt5 from neuraminidase__InfluenzaA__ADD14138

SEQ ID NO: 201096 - RNA, 1410 nt, Artificial Sequence; identical to SEQ ID NO: 199762
  derived and/or modified sequence opt5 from neuraminidase__InfluenzaA__ADD14142

SEQ ID NO: 201097 - RNA, 1410 nt, Artificial Sequence; identical to SEQ ID NO: 199762
  derived and/or modified sequence opt5 from neuraminidase__InfluenzaA__ADD14144

SEQ ID NO: 201098 - RNA, 1410 nt, Artificial Sequence; identical to SEQ ID NO: 199762
  derived and/or modified sequence opt5 from neuraminidase__InfluenzaA__ADD14146

SEQ ID NO: 201099 - RNA, 1410 nt, Artificial Sequence; identical to SEQ ID NO: 199762
  derived and/or modified sequence opt5 from neuraminidase__InfluenzaA__ADD14148

SEQ ID NO: 201100 - RNA, 1410 nt, Artificial Sequence
  derived and/or modified sequence opt5 from neuraminidase__InfluenzaA__ADD14150
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacgacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 201101 - RNA, 1410 nt, Artificial Sequence; identical to SEQ ID NO: 199762
  derived and/or modified sequence opt5 from neuraminidase__InfluenzaA__ADD14152

SEQ ID NO: 201102 - RNA, 1410 nt, Artificial Sequence
  derived and/or modified sequence opt5 from neuraminidase__InfluenzaA__ADD14154
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuauuacaaauuucgcugccgggcagagcguggucuccgugaaacuugcgggaaacucuagccugugcccuguuuccggcugggcuaucuacagcaaggacaauucuaucagaauuggguccaaaggagauguguuugucauccgggagccguucauuagcuguucuccccucgaaugccgcaccuuuuuccugacacagggcgcccuucugaacgacaagcauuccaauggcaccaucaaagauagaagcccuuaucggacgcucaugucuugucccauuggggaggugccuucccccuacaacagccgcuuugaauccguugccuggucugcuagcgccugccacgacggaaucaacuggcugaccaucggcauuuccgggccugauaauggagcuguggccguccugaaguauaacggcaucauuacagacaccaucaagagcuggagaaauaacauucuccggacacaagagucugagugugcgugcgugaauggguccuguuucaccgugaugacggauggaccgagcgacggccaggccucuuacaaaaucuuucgcaucgaaaagggcaaaauugucaagagcguugagaugaacgcucccaauuaucauuacgaagagugcuccuguuacccugauucuagcgagaucacaugcgugugcagagacaacuggcacggguccaaucggcccugggugagcuucaaccagaaucuggaauaucagauuggauacaucuguucuggcauuuuuggggauaacccucgccccaaugacaaaaccggauccugcggcccggucagcucuaacggggccaauggagugaagggcuucuccuuuaaguauggcaacgggguuuggaucggaagaacaaaaagcauuuccucucggaacggcuucgagaugaucugggauccuaauggguggaccggaaccgacaacaauuuuagcaucaagcaagacauugugggcaucaacgaaugguccggguacucuggcagcuucguccagcaucccgagcuuacaggacuggauuguauucgcccuugcuucuggguggaacucaucagaggccggcccaaagagaauacgauuuggaccuccgggagcucuaucuccuuuuguggaguuaacagcgacacagugggcuggucuuggcccgauggggcugagcugccuuucaccaucgacaaguga

SEQ ID NO: 201103 - RNA, 1410 nt, Artificial Sequence; identical to SEQ ID NO: 199762
  derived and/or modified sequence opt5 from neuraminidase__InfluenzaA__ADD14156

SEQ ID NO: 201104 - RNA, 1410 nt, Artificial Sequence; identical to SEQ ID NO: 199762
  derived and/or modified sequence opt5 from neuraminidase__InfluenzaA__ADD14158

SEQ ID NO: 201105 - RNA, 1410 nt, Artificial Sequence; identical to SEQ ID NO: 199762
  derived and/or modified sequence opt5 from neuraminidase__InfluenzaA__ADD14164

SEQ ID NO: 201106 - RNA, 1410 nt, Artificial Sequence; identical to SEQ ID NO: 199762
  derived and/or modified sequence opt5 from neuraminidase__InfluenzaA__ADD14174

SEQ ID NO: 201107 - RNA, 1410 nt, Artificial Sequence; identical to SEQ ID NO: 199762
  derived and/or modified sequence opt5 from neuraminidase__InfluenzaA__ADD14184

SEQ ID NO: 201108 - RNA, 1410 nt, Artificial Sequence; identical to SEQ ID NO: 199762
  derived and/or modified sequence opt5 from neuraminidase__InfluenzaA__ADD14194

SEQ ID NO: 201109 - RNA, 1410 nt, Artificial Sequence; identical to SEQ ID NO: 200116
  derived and/or modified sequence opt5 from neuraminidase__InfluenzaA__ADD14204

SEQ ID NO: 201110 - RNA, 1410 nt, Artificial Sequence
  derived and/or modified sequence opt5 from neuraminidase__InfluenzaA__ADD21449
augaaccccaaucagagaaucauuaccaucggcacagccugccugauuaucgggauugugagccuccugcuucaaaucggaaacaucgucucccuguggauuucucacagcauccagacgggcgagaagaaucauuccgaaaccuguaaccggaauacaauuaccuacgagaacucuacauggguuaaucagaccuaugugaacaucagcaauauuaacaucgcugggggacagggcguggccuccauuauccucgcgggaaauucuagccugugcccugucaacgggugggcuaucuacuccaaagacaauagcauucgcaucggcucuaagggcgauauuuucgugaucagagaaccguuuauuuccuguagccaccuugagugccggacauucuuucugacccaaggggcccuccugaacgaccgccauucuaauggaacgguuaaagauagaucccccuaucggacccugaugagcuguccuaucggcgaagcccccucuccuuacaacuccaaguucgagagcguggcuugguccgccucugcuugccacgacgggaugggauggcucacaaucggcauuagcgggcccgauaacggagccgucgcggugcugaaauauaauggcaucauuaccgacacaaucaaguccuggcgcaaccggauucuuagaacccaggagagcgaauguguuugcaucaauggcucuuguuuuacgaucaugacagaugggccuuccaacggacaggccagcuacaagauuuucaaaauggagcgcggcaagaucauuaaaucuguggaacuggacgcuccgaauuaucauuacgaggagugcagcuguuaccccgauaccgggaaggucgugugcgugugcagagacaacuggcacgccuccaaucggccuugggucucuuuugaucagaaccucgacuaucaaaucggauacauuagcuccggcguuuucggggauaauccccgcagcaacgacggaaaaggcaauuguggcccugugcugucuaacggggcuaauggagugaagggccuuuccuuuagauaugggaacggagucuggaucggccggacaaagagcaccaauucucgcuccggguucgaaaugauuugggaccccaacggcuggaccgagacagauagcaacuuuuccaugaaacaggacaucaucgcccugacggauuggucuggauacagcggcuccuucgugcagcacccggaacucaccgggaugaauugcauuagaccuuguuuuuggguugagcugauccggggacagcccaagcaaucuacaauuuggaccagcggcuccagcaucucuuucugcgggguggacuccgaaacagcgagcuggucuuggccugauggagccgaccugcccuucaccauugauaaauga

SEQ ID NO: 201111 - RNA, 1413 nt, Artificial Sequence
  derived and/or modified sequence opt5 from neuraminidase__InfluenzaA__ADD21469
augaaccccaaucagaagaucauuaccaucggcagcauuuccaucgccauugggaucaucucucugaugcuccaaauuggaaacaucauuagcgugugggcuucccacucuauccagacaggcagccagaaucauacggggauuugcaaccagagaaucauuaccuacgagaauagcacaugggucaaccacaccuauguuaauaucaacaauacaaacgugguggccggaaaagacaagaccucugucacacuggcgggcaauagcucccuuuguagcaucucugggugggcuauuuacaccaaagauaacuccauccggauuggaagcaagggcgacguguucguuauccgcgaaccuuuuauuucuugcucccaucuggaguguagaacguucuuucucacccaaggcgcccugcuuaaugauaaacacagcaacgggacagugaaggaccggucuccguaucgcgcccugauguccugcccccucggagaagcuccuagccccuacaauuccaaguucgagucugucgccuggagcgcuuccgccugucaugauggcaugggguggcugaccaucggaaucagcggcccugacaacggggcgguggccguucugaaauauaacggaauuaucacagaaaccauuaagucuuggaaaaagagaaugcuccggacgcaggaguccgagugcaucugugugaauggcagcugcuuuacaauuaugaccgauggccccucuaacggggcugccagcuacaaaaucuucaagaucgaaaagggaaaagucacaaaguccauugagcugaaugcuccuaacuuucacuaugaagaguguucuugcuacccggacaccggcaccgugaugugugugugccgcgauaauuggcacgggagcaacagacccugggucuccuucaaucagaaccuugacuaccagaucggauauauuugcagcggcguuuuuggggauaauccucggcccaaagacggagagggcucuuguaacccugugacaguggauggcgccgacggggucaagggauucuccuacaaauauggcaaugggguguggaucggacgcacgaaguccaacagacugcggaaaggcuuugaaaugauuugggaccccaauggguggaccgauacagacucuaacuucuccguuaagcaagauguggucgcgaucaccgacuggagcggcuacuccggaucuuuugugcagcauccggagcucacaggccuggauugcauucgcccuuguuucuggguugaacuugugagagggcugccccgggagaauaccacgaucuggacaagcggauccucuaucagcuucugcggcgucaacuccgacaccgccaacuggagcuggccugauggggcugaacuccccuuuaccauugacaaguga

SEQ ID NO: 201112 - RNA, 1410 nt, Artificial Sequence; identical to SEQ ID NO: 199762
  derived and/or modified sequence opt5 from neuraminidase__InfluenzaA__ADD21747

SEQ ID NO: 201113 - RNA, 1410 nt, Artificial Sequence
  derived and/or modified sequence opt5 from neuraminidase__InfluenzaA__ADD21767
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201114 - RNA, 1410 nt, Artificial Sequence
  derived and/or modified sequence opt5 from neuraminidase__InfluenzaA__ADD21777
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccgucauuaaguauaauggcaucauuacagacaccaucaagagcuggagaaacaauauucugcggacacaagagucugagugugcgugcgugaacggguccuguuucaccgugaugacggauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacaugcgugugcagagacaauuggcacggguccaaccggcccugggugagcuucaaucagaaccucgaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcugacaggacuugauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcucccuuucaccaucgacaaguga

SEQ ID NO: 201115 - RNA, 1410 nt, Artificial Sequence; identical to SEQ ID NO: 199762
  derived and/or modified sequence opt5 from neuraminidase__InfluenzaA__ADD21787

SEQ ID NO: 201116 - RNA, 1410 nt, Artificial Sequence; identical to SEQ ID NO: 199762
  derived and/or modified sequence opt5 from neuraminidase__InfluenzaA__ADD21797

SEQ ID NO: 201117 - RNA, 1410 nt, Artificial Sequence; identical to SEQ ID NO: 199762
  derived and/or modified sequence opt5 from neuraminidase__InfluenzaA__ADD21817

SEQ ID NO: 201118 - RNA, 1410 nt, Artificial Sequence; identical to SEQ ID NO: 199762
  derived and/or modified sequence opt5 from neuraminidase__InfluenzaA__ADD21827

SEQ ID NO: 201119 - RNA, 1410 nt, Artificial Sequence; identical to SEQ ID NO: 199762
  derived and/or modified sequence opt5 from neuraminidase__InfluenzaA__ADD21837

SEQ ID NO: 201120 - RNA, 1410 nt, Artificial Sequence; identical to SEQ ID NO: 199762
  derived and/or modified sequence opt5 from neuraminidase__InfluenzaA__ADD21847

SEQ ID NO: 201121 - RNA, 1410 nt, Artificial Sequence; identical to SEQ ID NO: 199762
  derived and/or modified sequence opt5 from neuraminidase__InfluenzaA__ADD21857

SEQ ID NO: 201122 - RNA, 1410 nt, Artificial Sequence; identical to SEQ ID NO: 199762
  derived and/or modified sequence opt5 from neuraminidase__InfluenzaA__ADD21867

SEQ ID NO: 201123 - RNA, 1410 nt, Artificial Sequence; identical to SEQ ID NO: 199762
  derived and/or modified sequence opt5 from neuraminidase__InfluenzaA__ADD21877

SEQ ID NO: 201124 - RNA, 1410 nt, Artificial Sequence; identical to SEQ ID NO: 199762
  derived and/or modified sequence opt5 from neuraminidase__InfluenzaA__ADD21897

SEQ ID NO: 201125 - RNA, 1410 nt, Artificial Sequence; identical to SEQ ID NO: 199762
  derived and/or modified sequence opt5 from neuraminidase__InfluenzaA__ADD22494

SEQ ID NO: 201126 - RNA, 1410 nt, Artificial Sequence; identical to SEQ ID NO: 199762
  derived and/or modified sequence opt5 from neuraminidase__InfluenzaA__ADD22504

SEQ ID NO: 201127 - RNA, 1410 nt, Artificial Sequence; identical to SEQ ID NO: 199762
  derived and/or modified sequence opt5 from neuraminidase__InfluenzaA__ADD22514

SEQ ID NO: 201128 - RNA, 1410 nt, Artificial Sequence; identical to SEQ ID NO: 199762
  derived and/or modified sequence opt5 from neuraminidase__InfluenzaA__ADD22524

SEQ ID NO: 201129 - RNA, 1410 nt, Artificial Sequence
  derived and/or modified sequence opt5 from neuraminidase__InfluenzaA__ADD22534
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauuccccucgccccaaugacaaaaccggaagcugcggcccggucucuuccaacggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 201130 - RNA, 1410 nt, Artificial Sequence; identical to SEQ ID NO: 199762
  derived and/or modified sequence opt5 from neuraminidase__InfluenzaA__ADD22544

SEQ ID NO: 201131 - RNA, 1410 nt, Artificial Sequence; identical to SEQ ID NO: 199762
  derived and/or modified sequence opt5 from neuraminidase__InfluenzaA__ADD22557

SEQ ID NO: 201132 - RNA, 1410 nt, Artificial Sequence; identical to SEQ ID NO: 199762
  derived and/or modified sequence opt5 from neuraminidase__InfluenzaA__ADD22567

SEQ ID NO: 201133 - RNA, 1410 nt, Artificial Sequence; identical to SEQ ID NO: 199762
  derived and/or modified sequence opt5 from neuraminidase__InfluenzaA__ADD22577

SEQ ID NO: 201134 - RNA, 1410 nt, Artificial Sequence; identical to SEQ ID NO: 199762
  derived and/or modified sequence opt5 from neuraminidase__InfluenzaA__ADD22587

SEQ ID NO: 201135 - RNA, 1410 nt, Artificial Sequence; identical to SEQ ID NO: 199762
  derived and/or modified sequence opt5 from neuraminidase__InfluenzaA__ADD22597

SEQ ID NO: 201136 - RNA, 1410 nt, Artificial Sequence; identical to SEQ ID NO: 199762
  derived and/or modified sequence opt5 from neuraminidase__InfluenzaA__ADD22617

SEQ ID NO: 201137 - RNA, 1410 nt, Artificial Sequence; identical to SEQ ID NO: 199762
  derived and/or modified sequence opt5 from neuraminidase__InfluenzaA__ADD22627

SEQ ID NO: 201138 - RNA, 1410 nt, Artificial Sequence; identical to SEQ ID NO: 199762
  derived and/or modified sequence opt5 from neuraminidase__InfluenzaA__ADD22637

SEQ ID NO: 201139 - RNA, 1410 nt, Artificial Sequence; identical to SEQ ID NO: 199762
  derived and/or modified sequence opt5 from neuraminidase__InfluenzaA__ADD22648

SEQ ID NO: 201140 - RNA, 1410 nt, Artificial Sequence; identical to SEQ ID NO: 199762
  derived and/or modified sequence opt5 from neuraminidase__InfluenzaA__ADD22658

SEQ ID NO: 201141 - RNA, 1410 nt, Artificial Sequence; identical to SEQ ID NO: 199762
  derived and/or modified sequence opt5 from neuraminidase__InfluenzaA__ADD22668

SEQ ID NO: 201142 - RNA, 1410 nt, Artificial Sequence
  derived and/or modified sequence opt5 from neuraminidase__InfluenzaA__ADD22688
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggauugaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201143 - RNA, 1410 nt, Artificial Sequence; identical to SEQ ID NO: 199762
  derived and/or modified sequence opt5 from neuraminidase__InfluenzaA__ADD22698

SEQ ID NO: 201144 - RNA, 1410 nt, Artificial Sequence; identical to SEQ ID NO: 199762
  derived and/or modified sequence opt5 from neuraminidase__InfluenzaA__ADD22725

SEQ ID NO: 201145 - RNA, 1410 nt, Artificial Sequence; identical to SEQ ID NO: 199762
  derived and/or modified sequence opt5 from neuraminidase__InfluenzaA__ADD22735

SEQ ID NO: 201146 - RNA, 1410 nt, Artificial Sequence; identical to SEQ ID NO: 199762
  derived and/or modified sequence opt5 from neuraminidase__InfluenzaA__ADD22745

SEQ ID NO: 201147 - RNA, 1410 nt, Artificial Sequence
  derived and/or modified sequence opt5 from neuraminidase__InfluenzaA__ADD22755
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcaccguuuccggcugggcuauuuacagcaaggacaacucuaucagaaucggguccaaaggagauguguuugucauucgggagccuuucaucagcuguucuccgcucgaaugccgcacauuuuuccugacccagggcgcccuucugaaugacaagcauuccaacggcacgauuaaagauagaagccccuaucggacccucaugucuuguccuaucggggaggugcccuccccuuacaacagccgcuuugaauccguugccuggucugcuagcgccugccacgacggaauuaauuggcugacaaucggcaucuccgggcccgauaacggagcuguggccguccugaaguauaauggcauuaucaccgacacaauuaagagcuggagaaacaauauccuccggacccaagagucugagugugcgugcgugaacggguccuguuucacggugaugacagauggaccuagcgacggccaggccucuuacaaaauuuuucgcaucgaaaagggcaaaaucgucaagagcguugagaugaaugcuccgaacuaucauuacgaagagugcuccuguuaccccgauucuagcgagauuaccugcgugugcagagacaauuggcacggguccaaccggccuugggugagcuucaaucagaaccuggaauaucagaucggauacauuuguucuggcaucuuuggggauagcccccgcccuaaugacaaaacaggauccugcggccccgucucuuccaacggggccaauggagugaagggcuucagcuuuaaguauggcaacgggguuuggauuggaagaaccaaauccaucucuagccggaacggcuucgagaugauuugggauccgaauggguggaccggaacagacaacaauuuuuccaucaagcaagacaucgugggcauuaacgaauggucuggguacagcggcuccuucguccagcauccugagcuuacgggacuggauuguauccgccccugcuucuggguggaacucauuagaggccggccuaaagagaauaccaucuggacaagcgggucuuccauuagcuuuuguggaguuaacucugacaccgugggcugguccuggcccgauggggcugagcugcccuucacaaucgacaaguga

SEQ ID NO: 201148 - RNA, 1410 nt, Artificial Sequence
  derived and/or modified sequence opt5 from neuraminidase__InfluenzaA__ADD22765
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugauugguccggguacucuggcagcuucguccagcaucccgaacuuacaggacuggacuguauccgcccuugcuucuggguggagcucauuagaggccggcccaaagaaaacacgaucuggaccuccgggagcucuauuuccuuuuguggaguuaauagcgauacagugggcuggucuuggcccgacggggcugagcugccuuucaccaucgauaaguga

SEQ ID NO: 201149 - RNA, 1410 nt, Artificial Sequence; identical to SEQ ID NO: 199762
  derived and/or modified sequence opt5 from neuraminidase__InfluenzaA__ADD22775

SEQ ID NO: 201150 - RNA, 1410 nt, Artificial Sequence; identical to SEQ ID NO: 199762
  derived and/or modified sequence opt5 from neuraminidase__InfluenzaA__ADD22785

SEQ ID NO: 201151 - RNA, 1410 nt, Artificial Sequence; identical to SEQ ID NO: 199762
  derived and/or modified sequence opt5 from neuraminidase__InfluenzaA__ADD22795

SEQ ID NO: 201152 - RNA, 1410 nt, Artificial Sequence; identical to SEQ ID NO: 199762
  derived and/or modified sequence opt5 from neuraminidase__InfluenzaA__ADD22805

SEQ ID NO: 201153 - RNA, 1410 nt, Artificial Sequence; identical to SEQ ID NO: 199762
  derived and/or modified sequence opt5 from neuraminidase__InfluenzaA__ADD22815

SEQ ID NO: 201154 - RNA, 1410 nt, Artificial Sequence; identical to SEQ ID NO: 199762
  derived and/or modified sequence opt5 from neuraminidase__InfluenzaA__ADD22825

SEQ ID NO: 201155 - RNA, 1410 nt, Artificial Sequence; identical to SEQ ID NO: 199762
  derived and/or modified sequence opt5 from neuraminidase__InfluenzaA__ADD22835

SEQ ID NO: 201156 - RNA, 1410 nt, Artificial Sequence; identical to SEQ ID NO: 199762
  derived and/or modified sequence opt5 from neuraminidase__InfluenzaA__ADD22845

SEQ ID NO: 201157 - RNA, 1410 nt, Artificial Sequence; identical to SEQ ID NO: 199762
  derived and/or modified sequence opt5 from neuraminidase__InfluenzaA__ADD22855

SEQ ID NO: 201158 - RNA, 1410 nt, Artificial Sequence; identical to SEQ ID NO: 199762
  derived and/or modified sequence opt5 from neuraminidase__InfluenzaA__ADD22924

SEQ ID NO: 201159 - RNA, 1410 nt, Artificial Sequence; identical to SEQ ID NO: 199762
  derived and/or modified sequence opt5 from neuraminidase__InfluenzaA__ADD22934

SEQ ID NO: 201160 - RNA, 1410 nt, Artificial Sequence; identical to SEQ ID NO: 199762
  derived and/or modified sequence opt5 from neuraminidase__InfluenzaA__ADD22944

SEQ ID NO: 201161 - RNA, 1410 nt, Artificial Sequence; identical to SEQ ID NO: 199762
  derived and/or modified sequence opt5 from neuraminidase__InfluenzaA__ADD22954

SEQ ID NO: 201162 - RNA, 1410 nt, Artificial Sequence; identical to SEQ ID NO: 199762
  derived and/or modified sequence opt5 from neuraminidase__InfluenzaA__ADD22974

SEQ ID NO: 201163 - RNA, 1410 nt, Artificial Sequence; identical to SEQ ID NO: 199762
  derived and/or modified sequence opt5 from neuraminidase__InfluenzaA__ADD23075

SEQ ID NO: 201164 - RNA, 1410 nt, Artificial Sequence
  derived and/or modified sequence opt5 from neuraminidase__InfluenzaA__ADD23085
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggaacucuucaucagcuguucuccgcuggagugccgcaccuuuuuccuuacacagggcgcccugcucaaugacaagcauuccaacggcaccauuaaagauagaagccccuaucggacgcugaugucuuguccuaucggggaggugcccuccccuuacaacagccgcuuugaauccguugccuggucugcuagcgccugccacgacggaauuaauuggcugaccaucggcaucuccgggcccgauaacggagcuguggccguccucaaguauaauggcauuaucacagacaccauuaagagcuggagaaacaauauccugcggacacaagagucugagugugcgugcgugaacggguccuguuucaccgugaugacggauggaccuagcgacggccaggccucuuacaaaauuuuucgcaucgaaaagggcaaaaucgucaagagcguugagaugaaugcuccgaacuaucauuacgaagagugcuccuguuaccccgauucuagcgagauuacaugcgugugcagagacaauuggcacggguccaaccggccuugggugagcuucaaucagaaccuugaauaucagaucggauacauuuguucuggcaucuuuggggauaauccccgcccuaacgacaaaaccggauccugcggccccgucagcucuaauggggccaacggagugaagggcuucuccuuuaaguauggcaacgggguuuggauuggaagaacaaaaagcaucuccucucggaauggcuucgagaugauuugggauccgaacggguggaccggaaccgacaauaacuuuagcaucaagcaagacaucgugggcauuaaugaaugguccggguacucuggcagcuucguccagcauccugagcugacaggacucgauuguauccgccccugcuucuggguggaacugauuagaggccggccuaaagagaacacgaucuggaccuccgggagcucuauuuccuuuuguggaguuaauagcgacacagugggcuggucuuggcccgauggggcugagcuucccuucaccaucgacaaguga

SEQ ID NO: 201165 - RNA, 1410 nt, Artificial Sequence; identical to SEQ ID NO: 199762
  derived and/or modified sequence opt5 from neuraminidase__InfluenzaA__ADD23095

SEQ ID NO: 201166 - RNA, 1410 nt, Artificial Sequence; identical to SEQ ID NO: 199762
  derived and/or modified sequence opt5 from neuraminidase__InfluenzaA__ADD23105

SEQ ID NO: 201167 - RNA, 1410 nt, Artificial Sequence; identical to SEQ ID NO: 199762
  derived and/or modified sequence opt5 from neuraminidase__InfluenzaA__ADD23115

SEQ ID NO: 201168 - RNA, 1410 nt, Artificial Sequence; identical to SEQ ID NO: 199762
  derived and/or modified sequence opt5 from neuraminidase__InfluenzaA__ADD23125

SEQ ID NO: 201169 - RNA, 1410 nt, Artificial Sequence; identical to SEQ ID NO: 199762
  derived and/or modified sequence opt5 from neuraminidase__InfluenzaA__ADD23135

SEQ ID NO: 201170 - RNA, 1410 nt, Artificial Sequence; identical to SEQ ID NO: 199762
  derived and/or modified sequence opt5 from neuraminidase__InfluenzaA__ADD23145

SEQ ID NO: 201171 - RNA, 1410 nt, Artificial Sequence; identical to SEQ ID NO: 199762
  derived and/or modified sequence opt5 from neuraminidase__InfluenzaA__ADD23155

SEQ ID NO: 201172 - RNA, 1410 nt, Artificial Sequence; identical to SEQ ID NO: 199762
  derived and/or modified sequence opt5 from neuraminidase__InfluenzaA__ADD23165

SEQ ID NO: 201173 - RNA, 1410 nt, Artificial Sequence; identical to SEQ ID NO: 199762
  derived and/or modified sequence opt5 from neuraminidase__InfluenzaA__ADD23175

SEQ ID NO: 201174 - RNA, 1410 nt, Artificial Sequence; identical to SEQ ID NO: 199762
  derived and/or modified sequence opt5 from neuraminidase__InfluenzaA__ADD23185

SEQ ID NO: 201175 - RNA, 1410 nt, Artificial Sequence; identical to SEQ ID NO: 199762
  derived and/or modified sequence opt5 from neuraminidase__InfluenzaA__ADD23195

SEQ ID NO: 201176 - RNA, 1410 nt, Artificial Sequence; identical to SEQ ID NO: 199762
  derived and/or modified sequence opt5 from neuraminidase__InfluenzaA__ADD23223

SEQ ID NO: 201177 - RNA, 1410 nt, Artificial Sequence
  derived and/or modified sequence opt5 from neuraminidase__InfluenzaA__ADD23233
augaaccccaaucagaagaucauuaccaucggcagcgugugcaugacaauugggauggccaaccugauccuccaaauuggaaauaucaucuccauuuggaucggccacucuauucagcuggggaaccagaaucagaucgagacguguaaccaaagcgucauuaccuacgaaaauaacacauggguuaaucagaccuaugugaacaucuccaauacaaacuucgcugccggacagucuguggucagcgugaaacuugcgggcaauuccucucugugcccuguuagcgggugggcuauuuacuccaaggacaacagcaucagaaucggaucuaaaggcgauguguuugucauucgggagccguucaucuccuguagcccccucgaaugccgcaccuuuuuccugacacagggcgcccuucugaaugacaagcauucuaacgggaccauuaaagauagauccccuuaucggacgcucaugagcugucccaucggagaggugccuucucccuacaacucccgcuuugaaagcguugccugguccgcuucugccugccacgacggcauuaauuggcugaccaucgggaucagcggaccugauaacggcgcuguggccguccugaaguauaaugggauuaucacagacaccauuaaguccuggagaaacaauauccuccggacacaagagagcgagugugcgugcgugaacggaucuuguuucaccgugaugacggauggcccguccgacggccaggccagcuacaaaauuuuucgcaucgaaaaggggaaaaucgucaagucuguugagaugaaugcucccaacuaucauuacgaagagugcagcuguuacccugauuccucugagauuacaugcgugugcagagacaauuggcacggaagcaaccggcccuggguguccuucaaucagaaccuggaauaucagaucggcuacauuuguagcgggaucuuuggagauaauccucgccccaacgacaaaaccggcucuugcgggccggucuccagcaauggagccaacggcgugaagggcuucucuuuuaaguaugggaacggaguuuggauuggcagaacaaaauccaucagcucccggaauggguucgagaugauuugggauccuaacggauggaccggcaccgacaauaacuuuucuaucaagcaagacaucguggggauuaaugaauggagcggcuacuccggaucuuucguccagcaucccgagcuuacaggccuggauuguauccgcccuugcuucuggguggaacucauuagagggcggcccaaagagaacacgaucuggaccagcggauccagcauuucuuuuuguggcguuaauuccgacacagugggguggagcuggcccgauggagcugagcugccuuucaccaucgacaaguga

SEQ ID NO: 201178 - RNA, 1410 nt, Artificial Sequence; identical to SEQ ID NO: 199762
  derived and/or modified sequence opt5 from neuraminidase__InfluenzaA__ADD23243

SEQ ID NO: 201179 - RNA, 1410 nt, Artificial Sequence; identical to SEQ ID NO: 201050
  derived and/or modified sequence opt5 from neuraminidase__InfluenzaA__ADD23253

SEQ ID NO: 201180 - RNA, 1410 nt, Artificial Sequence
  derived and/or modified sequence opt5 from neuraminidase__InfluenzaA__ADD23273
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccgagggagauguguuugucauucgggaaccguucaucagcuguucuccccucgagugccgcaccuuuuuccugacacagggcgcccuucugaaugacaaacauuccaacggcaccauuaaggauagaagcccuuaucggacgcucaugucuugucccaucggggaagugccuucccccuacaacagccgcuuugaguccguugccuggucugcuagcgccugccacgacggaauuaauuggcugaccaucggcaucuccgggccugauaacggagcuguggccguccugaaauauaauggcauuaucacagacaccauuaagagcuggagaaacaauauccuccggacacaagagucugaaugugcgugcgugaacggguccuguuucaccgugaugacggauggaccgagcgacggccaggccucuuacaagauuuuucgcaucgagaaaggcaagaucgucaaaagcguugaaaugaaugcucccaacuaucauuacgaggagugcuccuguuacccugauucuagcgaaauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaaaggcuucuccuuuaaguauggcaacgggguuuggauuggaagaacaaagagcaucuccucucggaauggcuucgaaaugauuugggauccuaacggguggaccggaaccgacaauaacuuuagcaucaaacaagacaucgugggcauuaaugagugguccggguacucuggcagcuucguccagcaucccgaacuuacaggacuggauuguauccgcccuugcuucuggguggagcucauuagaggccggcccaaggagaacacgaucuggaccuccgggagcucuauuuccuuuuguggaguuaauagcgacacagugggcuggucuuggcccgauggggcugaacugccuuucaccaucgacaaauga

SEQ ID NO: 201181 - RNA, 1410 nt, Artificial Sequence; identical to SEQ ID NO: 199762
  derived and/or modified sequence opt5 from neuraminidase__InfluenzaA__ADD23283

SEQ ID NO: 201182 - RNA, 1410 nt, Artificial Sequence; identical to SEQ ID NO: 199762
  derived and/or modified sequence opt5 from neuraminidase__InfluenzaA__ADD23293

SEQ ID NO: 201183 - RNA, 1410 nt, Artificial Sequence; identical to SEQ ID NO: 199762
  derived and/or modified sequence opt5 from neuraminidase__InfluenzaA__ADD23303

SEQ ID NO: 201184 - RNA, 1410 nt, Artificial Sequence; identical to SEQ ID NO: 199762
  derived and/or modified sequence opt5 from neuraminidase__InfluenzaA__ADD23313

SEQ ID NO: 201185 - RNA, 1410 nt, Artificial Sequence
  derived and/or modified sequence opt5 from neuraminidase__InfluenzaA__ADD23323
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugcugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuugaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcugacaggacucgauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 201186 - RNA, 1410 nt, Artificial Sequence; identical to SEQ ID NO: 199762
  derived and/or modified sequence opt5 from neuraminidase__InfluenzaA__ADD23333

SEQ ID NO: 201187 - RNA, 1410 nt, Artificial Sequence; identical to SEQ ID NO: 199762
  derived and/or modified sequence opt5 from neuraminidase__InfluenzaA__ADD23358

SEQ ID NO: 201188 - RNA, 1410 nt, Artificial Sequence; identical to SEQ ID NO: 201113
  derived and/or modified sequence opt5 from neuraminidase__InfluenzaA__ADD23368

SEQ ID NO: 201189 - RNA, 1410 nt, Artificial Sequence; identical to SEQ ID NO: 199762
  derived and/or modified sequence opt5 from neuraminidase__InfluenzaA__ADD23378

SEQ ID NO: 201190 - RNA, 1410 nt, Artificial Sequence; identical to SEQ ID NO: 199762
  derived and/or modified sequence opt5 from neuraminidase__InfluenzaA__ADD23388

SEQ ID NO: 201191 - RNA, 1410 nt, Artificial Sequence; identical to SEQ ID NO: 200345
  derived and/or modified sequence opt5 from neuraminidase__InfluenzaA__ADD23398

SEQ ID NO: 201192 - RNA, 1410 nt, Artificial Sequence
  derived and/or modified sequence opt5 from neuraminidase__InfluenzaA__ADD23408
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucaggaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 201193 - RNA, 1410 nt, Artificial Sequence
  derived and/or modified sequence opt5 from neuraminidase__InfluenzaA__ADD23438
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauagcuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 201194 - RNA, 1410 nt, Artificial Sequence; identical to SEQ ID NO: 199762
  derived and/or modified sequence opt5 from neuraminidase__InfluenzaA__ADD23448

SEQ ID NO: 201195 - RNA, 1410 nt, Artificial Sequence; identical to SEQ ID NO: 199762
  derived and/or modified sequence opt5 from neuraminidase__InfluenzaA__ADD23458

SEQ ID NO: 201196 - RNA, 1410 nt, Artificial Sequence
  derived and/or modified sequence opt5 from neuraminidase__InfluenzaA__ADD23468
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcgucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 201197 - RNA, 1410 nt, Artificial Sequence; identical to SEQ ID NO: 199762
  derived and/or modified sequence opt5 from neuraminidase__InfluenzaA__ADD23478

SEQ ID NO: 201198 - RNA, 1410 nt, Artificial Sequence; identical to SEQ ID NO: 199762
  derived and/or modified sequence opt5 from neuraminidase__InfluenzaA__ADD23488

SEQ ID NO: 201199 - RNA, 1410 nt, Artificial Sequence
  derived and/or modified sequence opt5 from neuraminidase__InfluenzaA__ADD23498
augaaccccaaucagaagaucauuaccaucggcagcgugugcaugacaauugggauggccaaccugauccuccaaauuggaaauaucaucuccauuuggaucucucacagcauucagcugggcaaccagaaucauaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagaaacaauauccuccggacacaggagucugagugugcgugcgugaacggguccuguuucaccgugaugacggauggaccgagcgacggccaagccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguacucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 201200 - RNA, 1410 nt, Artificial Sequence; identical to SEQ ID NO: 199762
  derived and/or modified sequence opt5 from neuraminidase__InfluenzaA__ADD23508

SEQ ID NO: 201201 - RNA, 1410 nt, Artificial Sequence; identical to SEQ ID NO: 199762
  derived and/or modified sequence opt5 from neuraminidase__InfluenzaA__ADD23518

SEQ ID NO: 201202 - RNA, 1410 nt, Artificial Sequence; identical to SEQ ID NO: 199762
  derived and/or modified sequence opt5 from neuraminidase__InfluenzaA__ADD23997

SEQ ID NO: 201203 - RNA, 1410 nt, Artificial Sequence; identical to SEQ ID NO: 199762
  derived and/or modified sequence opt5 from neuraminidase__InfluenzaA__ADD24007

SEQ ID NO: 201204 - RNA, 1410 nt, Artificial Sequence; identical to SEQ ID NO: 199762
  derived and/or modified sequence opt5 from neuraminidase__InfluenzaA__ADD24017

SEQ ID NO: 201205 - RNA, 1410 nt, Artificial Sequence; identical to SEQ ID NO: 199762
  derived and/or modified sequence opt5 from neuraminidase__InfluenzaA__ADD24024

SEQ ID NO: 201206 - RNA, 1410 nt, Artificial Sequence; identical to SEQ ID NO: 199762
  derived and/or modified sequence opt5 from neuraminidase__InfluenzaA__ADD24025

SEQ ID NO: 201207 - RNA, 1410 nt, Artificial Sequence; identical to SEQ ID NO: 199762
  derived and/or modified sequence opt5 from neuraminidase__InfluenzaA__ADD24026

SEQ ID NO: 201208 - RNA, 1410 nt, Artificial Sequence; identical to SEQ ID NO: 199762
  derived and/or modified sequence opt5 from neuraminidase__InfluenzaA__ADD24027

SEQ ID NO: 201209 - RNA, 1410 nt, Artificial Sequence; identical to SEQ ID NO: 199762
  derived and/or modified sequence opt5 from neuraminidase__InfluenzaA__ADD24028

SEQ ID NO: 201210 - RNA, 1410 nt, Artificial Sequence; identical to SEQ ID NO: 199762
  derived and/or modified sequence opt5 from neuraminidase__InfluenzaA__ADD24029

SEQ ID NO: 201211 - RNA, 1410 nt, Artificial Sequence; identical to SEQ ID NO: 199762
  derived and/or modified sequence opt5 from neuraminidase__InfluenzaA__ADD24030

SEQ ID NO: 201212 - RNA, 1410 nt, Artificial Sequence; identical to SEQ ID NO: 199762
  derived and/or modified sequence opt5 from neuraminidase__InfluenzaA__ADD24031

SEQ ID NO: 201213 - RNA, 1410 nt, Artificial Sequence; identical to SEQ ID NO: 199762
  derived and/or modified sequence opt5 from neuraminidase__InfluenzaA__ADD24032

SEQ ID NO: 201214 - RNA, 1410 nt, Artificial Sequence; identical to SEQ ID NO: 199762
  derived and/or modified sequence opt5 from neuraminidase__InfluenzaA__ADD25231

SEQ ID NO: 201215 - RNA, 1410 nt, Artificial Sequence; identical to SEQ ID NO: 199762
  derived and/or modified sequence opt5 from neuraminidase__InfluenzaA__ADD25233

SEQ ID NO: 201216 - RNA, 1410 nt, Artificial Sequence; identical to SEQ ID NO: 199762
  derived and/or modified sequence opt5 from neuraminidase__InfluenzaA__ADD25235

SEQ ID NO: 201217 - RNA, 1410 nt, Artificial Sequence; identical to SEQ ID NO: 199762
  derived and/or modified sequence opt5 from neuraminidase__InfluenzaA__ADD25244

SEQ ID NO: 201218 - RNA, 1410 nt, Artificial Sequence
  derived and/or modified sequence opt5 from neuraminidase__InfluenzaA__ADD25246
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaaccaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 201219 - RNA, 1410 nt, Artificial Sequence; identical to SEQ ID NO: 199762
  derived and/or modified sequence opt5 from neuraminidase__InfluenzaA__ADD25248

SEQ ID NO: 201220 - RNA, 1410 nt, Artificial Sequence
  derived and/or modified sequence opt5 from neuraminidase__InfluenzaA__ADD25250
augaaccccaaucagaagaucauuaccaucggcagcgugugcaugacaauugggauggccaaccugauccuccaaauuggaaauaucaucuccauuuggaucucuagaagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuauccggauuggguccaaaggagauguuuuugugauccgcgagccguucauuagcuguucuccccucgaaugcagaaccuuuuuccugacacagggcgcccuucugaaugacaagcacuccaacggcaccaucaaagaucggagcccuuaucgcacgcucaugucuugucccauuggggaggucccuucccccuacaacagcagauuugaauccguggccuggucugcuagcgccugccaugacggaaucaauuggcugaccaucggcauuuccgggccugauaacggagcuguugccgugcugaaguauaauggcaucauuacagacaccaucaagagcuggcggaacaauauucuccgcacacaagagucugagugugcgugcgucaacggguccuguuucaccgugaugacggauggaccgagcgacggccaggccucuuacaaaaucuuuagaaucgaaaagggcaaaauugugaaguccgucgagaugaaugcucccaacuaucacuacgaagagugcuccuguuacccugauucuggggagaucacaugcguuugccgggacaauuggcauggaagcaaccgccccuggguguccuucaaucagaaccuggaauaucagauuggcuacaucuguagcgggauuuuuggagauaauccuagacccaacgacaaaaccggcucuugcgggccgguguccagcaauggagccaacggcgucaagggcuucucuuuuaaguaugggaacggaguguggaucggccggacaaaauccauuagcucccgcaauggguucgagaugaucugggauccuaacggauggaccggcaccgacaauaacuuuucuaucaagcaagacauuguugggaucaaugaauggagcggcuacuccggaucuuucgugcagcaccccgagcuuacaggccuggauuguauuagaccuugcuucugggucgaacucauccgggggcgccccaaagagaacacgauuuggaccagcggauccagcaucucuuuuuguggcgugaauagcgacacaaugggguggagcuggcccgauggagcugagcugccuuucaccaucgacaaguga

SEQ ID NO: 201221 - RNA, 1410 nt, Artificial Sequence; identical to SEQ ID NO: 199762
  derived and/or modified sequence opt5 from neuraminidase__InfluenzaA__ADD25255

SEQ ID NO: 201222 - RNA, 1410 nt, Artificial Sequence; identical to SEQ ID NO: 199762
  derived and/or modified sequence opt5 from neuraminidase__InfluenzaA__ADD25259

SEQ ID NO: 201223 - RNA, 1410 nt, Artificial Sequence
  derived and/or modified sequence opt5 from neuraminidase__InfluenzaA__ADD25262
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccgauggagugaagggcuucuccuuuaaauauggcaacgggguuuggauuggaagaaccaagagcaucuccucucggaacggcuucgagaugauuugggacccuaauggguggacaggaaccgacaacaauuuuagcaucaaacaagauaucgugggcauuaacgaaugguccggguacucuggcagcuucguccagcaucccgagcuuaccggacuggacuguauccgcccuugcuucuggguggaacucauuagaggccggcccaaggagaauacaaucuggacguccgggagcucuauuuccuuuuguggaguuaacagcgauaccgugggcuggucuuggcccgacggggcugagcugccuuucacaaucgauaaauga

SEQ ID NO: 201224 - RNA, 1410 nt, Artificial Sequence
  derived and/or modified sequence opt5 from neuraminidase__InfluenzaA__ADD25266
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucccugugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacgggagcaaccggccuuggguguccuucaaucagaaccuggaauaucagaucggauacauuuguagcggcaucuuuggggauaauccccgcccgaacgacaaaaccggaucuugcggcccugucuccagcaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcugagcugccguucaccaucgacaaguga

SEQ ID NO: 201225 - RNA, 1410 nt, Artificial Sequence; identical to SEQ ID NO: 199762
  derived and/or modified sequence opt5 from neuraminidase__InfluenzaA__ADD25268

SEQ ID NO: 201226 - RNA, 1410 nt, Artificial Sequence; identical to SEQ ID NO: 199762
  derived and/or modified sequence opt5 from neuraminidase__InfluenzaA__ADD25271

SEQ ID NO: 201227 - RNA, 1410 nt, Artificial Sequence; identical to SEQ ID NO: 199762
  derived and/or modified sequence opt5 from neuraminidase__InfluenzaA__ADD25274

SEQ ID NO: 201228 - RNA, 1410 nt, Artificial Sequence; identical to SEQ ID NO: 199762
  derived and/or modified sequence opt5 from neuraminidase__InfluenzaA__ADD25276

SEQ ID NO: 201229 - RNA, 1410 nt, Artificial Sequence
  derived and/or modified sequence opt5 from neuraminidase__InfluenzaA__ADD25278
augaaccccaaucagaagaucauuaccaucggcagcgugugcaugacaauugggauggccaaccugauccuccaaauuggaaauaucaucuccauuuggaucucuagaagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuauccggauuggguccaaaggagauguuuuugugauccgcgagccguucauuagcuguucuccccucgaaugcagaaccuuuuuccugacacagggcgcccuucugaaugacaagcacuccaacggcaccaucaaagaucggagcccuuaucgcacgcucaugucuugucccauuggggaggucccuucccccuacaacagcagauuugaauccguggccuggucugcuagcgccugccaugacggaaucaauuggcugaccaucggcauuuccgggccugauaacggagcuguugccgugcugaaguauaauggcaucauuacagacaccaucaagagcuggcggaacaauauucuccgcacacaagagucugagugugcgugcgucaacggguccuguuucaccgugaugacggauggaccgagcgacggccaggccucuuacaaaaucuuuagaaucgaaaagggcaaaauugugaaguccgucgagaugaaugcucccaacuaucacuacgaagagugcuccuguuacccugauucuggggagaucacaugcguuugccgggacaauuggcauggaagcaaccgccccuggguguccuucaaucagaaccuggaauaucagauuggcuacaucuguagcgggauuuuuggagauaauccuagacccaacgacaaaaccggcucuugcgggccgguguccagcaauggagccaacggcgucaagggcuucucuuuuaaguaugggaacggaguguggaucggccggacaaaauccauuagcucccgcaauggguucgagaugaucugggauccuaacggauggaccggcaccgacaauaacuuuucuaucaagcaagacauuguugggaucaaugaauggagcggcuacuccggaucuuucgugcagcaccccgagcuuacaggccuggauuguauuagaccuugcuucugggucgaacucauccgggggcgccccaaagagaacacgauuuggaccagcggauccagcaucucuuuuuguggcgugaauagcgacacaguuggguggagcuggcccgauggagcugagcugccuuucaccaucgacaaguga

SEQ ID NO: 201230 - RNA, 1410 nt, Artificial Sequence; identical to SEQ ID NO: 199762
  derived and/or modified sequence opt5 from neuraminidase__InfluenzaA__ADD25280

SEQ ID NO: 201231 - RNA, 1410 nt, Artificial Sequence; identical to SEQ ID NO: 199762
  derived and/or modified sequence opt5 from neuraminidase__InfluenzaA__ADD25282

SEQ ID NO: 201232 - RNA, 1410 nt, Artificial Sequence; identical to SEQ ID NO: 201050
  derived and/or modified sequence opt5 from neuraminidase__InfluenzaA__ADD25284

SEQ ID NO: 201233 - RNA, 1410 nt, Artificial Sequence; identical to SEQ ID NO: 199762
  derived and/or modified sequence opt5 from neuraminidase__InfluenzaA__ADD25287

SEQ ID NO: 201234 - RNA, 1410 nt, Artificial Sequence; identical to SEQ ID NO: 199762
  derived and/or modified sequence opt5 from neuraminidase__InfluenzaA__ADD25291

SEQ ID NO: 201235 - RNA, 1410 nt, Artificial Sequence; identical to SEQ ID NO: 201050
  derived and/or modified sequence opt5 from neuraminidase__InfluenzaA__ADD25293

SEQ ID NO: 201236 - RNA, 1410 nt, Artificial Sequence; identical to SEQ ID NO: 199762
  derived and/or modified sequence opt5 from neuraminidase__InfluenzaA__ADD25300

SEQ ID NO: 201237 - RNA, 1410 nt, Artificial Sequence
  derived and/or modified sequence opt5 from neuraminidase__InfluenzaA__ADD25304
augaaccccaaucagaagaucauuaccaucggcagcgugugcaugacaauugggauggccaaccugauccuccaaauuggaaauaucgucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 201238 - RNA, 1410 nt, Artificial Sequence
  derived and/or modified sequence opt5 from neuraminidase__InfluenzaA__ADD25306
augaaccccaaucagaagaucauuaccaucggcagcgugugcaugacaauugggauggccaaccugauccuccaaauuggaaauaucaucuccauuuggaucucuagaagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuauccggauuggguccaaaggagauguuuuugugauccgcgagccguucauuagcuguucuccccucgaaugcagaaccuuuuuccugacacagggcgcccuucugaaugacaagcacuccaacggcaccaucaaagaucggagcccuuaucgcacgcucaugucuugucccauuggggaggucccuucccccuacaacagcagauuugaauccguggccuggucugcuagcgccugccaugacggaaucaauuggcugaccaucggcauuuccgggccugauaacggagcuguugccgugcugaaguauaauggcaucauuacagacaccaucaagagcuggcggaacaauauucuccgcacacaagagucugagugugcgugcgucaacggguccuguuucaccgugaugacggaugaaccgagcgacggacaggccucuuacaaaaucuuuagaaucgagaagggcaaaauugugaaguccgucgaaaugaaugcucccaacuaucacuacgaggagugcuccuguuacccugauucuggcgaaaucacaugcguuugccgggacaauuggcaugggagcaaccgccccuggguguccuucaaucagaaccuggaguaucagauuggauacaucuguagcggcauuuuuggggauaauccuagacccaacgacaaaaccggaucuugcggcccgguguccagcaauggggccaacggagucaagggcuucucuuuuaaguauggcaacgggguguggaucggacggacaaaauccauuagcucccgcaauggcuucgaaaugaucugggauccuaacggguggaccggaaccgacaauaacuuuucuaucaagcaagacauuguuggcaucaaugaguggagcggguacuccggcucuuucgugcagcaccccgaacuuacaggacuggauuguauuagaccuugcuucugggucgagcucauccggggccgccccaaagagaacacgauuuggaccagcggguccagcaucucuuuuuguggagugaauagcgacacaguuggcuggagcuggcccgauggggcugaacugccuuucaccaucgacaaguga

SEQ ID NO: 201239 - RNA, 1410 nt, Artificial Sequence; identical to SEQ ID NO: 199762
  derived and/or modified sequence opt5 from neuraminidase__InfluenzaA__ADD25308

SEQ ID NO: 201240 - RNA, 1410 nt, Artificial Sequence; identical to SEQ ID NO: 199762
  derived and/or modified sequence opt5 from neuraminidase__InfluenzaA__ADD25310

SEQ ID NO: 201241 - RNA, 1410 nt, Artificial Sequence; identical to SEQ ID NO: 199762
  derived and/or modified sequence opt5 from neuraminidase__InfluenzaA__ADD25312

SEQ ID NO: 201242 - RNA, 1410 nt, Artificial Sequence; identical to SEQ ID NO: 199762
  derived and/or modified sequence opt5 from neuraminidase__InfluenzaA__ADD25314

SEQ ID NO: 201243 - RNA, 1410 nt, Artificial Sequence; identical to SEQ ID NO: 199762
  derived and/or modified sequence opt5 from neuraminidase__InfluenzaA__ADD25316

SEQ ID NO: 201244 - RNA, 1410 nt, Artificial Sequence; identical to SEQ ID NO: 199762
  derived and/or modified sequence opt5 from neuraminidase__InfluenzaA__ADD29799

SEQ ID NO: 201245 - RNA, 1410 nt, Artificial Sequence; identical to SEQ ID NO: 199762
  derived and/or modified sequence opt5 from neuraminidase__InfluenzaA__ADD29800

SEQ ID NO: 201246 - RNA, 1410 nt, Artificial Sequence; identical to SEQ ID NO: 199762
  derived and/or modified sequence opt5 from neuraminidase__InfluenzaA__ADD29801

SEQ ID NO: 201247 - RNA, 1410 nt, Artificial Sequence; identical to SEQ ID NO: 199762
  derived and/or modified sequence opt5 from neuraminidase__InfluenzaA__ADD29802

SEQ ID NO: 201248 - RNA, 1410 nt, Artificial Sequence; identical to SEQ ID NO: 199762
  derived and/or modified sequence opt5 from neuraminidase__InfluenzaA__ADD29803

SEQ ID NO: 201249 - RNA, 1410 nt, Artificial Sequence; identical to SEQ ID NO: 199762
  derived and/or modified sequence opt5 from neuraminidase__InfluenzaA__ADD29804

SEQ ID NO: 201250 - RNA, 1410 nt, Artificial Sequence; identical to SEQ ID NO: 199762
  derived and/or modified sequence opt5 from neuraminidase__InfluenzaA__ADD29805

SEQ ID NO: 201251 - RNA, 1410 nt, Artificial Sequence; identical to SEQ ID NO: 199762
  derived and/or modified sequence opt5 from neuraminidase__InfluenzaA__ADD29806

SEQ ID NO: 201252 - RNA, 1410 nt, Artificial Sequence; identical to SEQ ID NO: 199762
  derived and/or modified sequence opt5 from neuraminidase__InfluenzaA__ADD29807

SEQ ID NO: 201253 - RNA, 1410 nt, Artificial Sequence; identical to SEQ ID NO: 199762
  derived and/or modified sequence opt5 from neuraminidase__InfluenzaA__ADD29808

SEQ ID NO: 201254 - RNA, 1410 nt, Artificial Sequence; identical to SEQ ID NO: 199762
  derived and/or modified sequence opt5 from neuraminidase__InfluenzaA__ADD52538

SEQ ID NO: 201255 - RNA, 1410 nt, Artificial Sequence; identical to SEQ ID NO: 200985
  derived and/or modified sequence opt5 from neuraminidase__InfluenzaA__ADD74353

SEQ ID NO: 201256 - RNA, 1410 nt, Artificial Sequence; identical to SEQ ID NO: 199762
  derived and/or modified sequence opt5 from neuraminidase__InfluenzaA__ADD74373

SEQ ID NO: 201257 - RNA, 1410 nt, Artificial Sequence; identical to SEQ ID NO: 199762
  derived and/or modified sequence opt5 from neuraminidase__InfluenzaA__ADD74383

SEQ ID NO: 201258 - RNA, 1410 nt, Artificial Sequence; identical to SEQ ID NO: 199762
  derived and/or modified sequence opt5 from neuraminidase__InfluenzaA__ADD74401

SEQ ID NO: 201259 - RNA, 1410 nt, Artificial Sequence
  derived and/or modified sequence opt5 from neuraminidase__InfluenzaA__ADD74411
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacguggcugccgggcagagcgucguguccguuaaacuugcgggaaauucuagccugugcccuguguccggcugggcuauuuacagcaaggacaacucuaucagaaucggguccaaaggagaugucuucgugauucgggagccguuuaucagcuguucuccccucgaaugccgcaccuucuuucugacacagggcgcccuucugaaugacaagcauuccaacggcaccauuaaagauagaagcccuuaucggacgcucaugucuugucccaucggggagguuccuucccccuacaacagccgcuucgaauccguggccuggucugcuagcgccugccacgacggaauuaauuggcugaccaucggcaucuccgggccugauaacggagcugucgccgugcugaaguauaauggcauuaucacagacaccauuaagagcuggagaaacaauauccuccggacacaagagucugagugugcgugcgugaacggguccuguuuuaccgucaugacggauggaccgagcgacggccaggccucuuacaaaauuuuccgcaucgaaaagggcaaaaucguuaagagcguggagaugaaugcucccaacuaucauuacgaagagugcuccuguuacccugauucuagcgagauuacaugcgugugcagagacaauuggcacggguccaaccggcccugggucagcuuuaaucagaaccuggaauaucagaucggauacauuuguucuggcaucuucggggauaauccucgccccaacgacaaaaccggauccugcggcccggugagcucuaauggggccaacggaguuaagggcuuuuccuucaaguauggcagcgggguguggauuggaagaacaaaauccaucucuagccgguccggcuuugagaugauuugggauccuaacggguggaccggaaccgacaauaacuucucuaucaagcaagacaucgucggcauuaaugaauggagcggguacuccggcagcuuugugcagcaucccgagcuuacaggacuggauuguauccgcccuugcuucuggguugaacucauuagaggccggcccaaagagaacacgaucuggaccucuggguccagcauuucuuucuguggagucaauuccgacacagugggcuggagcuggcccgauggggcugagcugccuuuuaccaucgacaaguga

SEQ ID NO: 201260 - RNA, 1410 nt, Artificial Sequence; identical to SEQ ID NO: 199762
  derived and/or modified sequence opt5 from neuraminidase__InfluenzaA__ADD74421

SEQ ID NO: 201261 - RNA, 1410 nt, Artificial Sequence; identical to SEQ ID NO: 199762
  derived and/or modified sequence opt5 from neuraminidase__InfluenzaA__ADD74431

SEQ ID NO: 201262 - RNA, 1410 nt, Artificial Sequence
  derived and/or modified sequence opt5 from neuraminidase__InfluenzaA__ADD74441
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaucuuuagcaucaagcaagacauugugggcaucaacgaaugguccggguacucuggcagcuucguccagcaucccgagcuuacaggacuggauuguauucgcccuugcuucuggguggaacucaucagaggccggcccaaagagaauacgauuuggaccuccgggagcucuaucuccuuuuguggaguuaacagcgacacagugggcuggucuuggcccgauggggcugagcugccuuucaccaucgacaaguga

SEQ ID NO: 201263 - RNA, 1410 nt, Artificial Sequence; identical to SEQ ID NO: 199762
  derived and/or modified sequence opt5 from neuraminidase__InfluenzaA__ADD74451

SEQ ID NO: 201264 - RNA, 1410 nt, Artificial Sequence; identical to SEQ ID NO: 199762
  derived and/or modified sequence opt5 from neuraminidase__InfluenzaA__ADD74461

SEQ ID NO: 201265 - RNA, 1410 nt, Artificial Sequence; identical to SEQ ID NO: 199762
  derived and/or modified sequence opt5 from neuraminidase__InfluenzaA__ADD74471

SEQ ID NO: 201266 - RNA, 1410 nt, Artificial Sequence; identical to SEQ ID NO: 199762
  derived and/or modified sequence opt5 from neuraminidase__InfluenzaA__ADD74481

SEQ ID NO: 201267 - RNA, 1410 nt, Artificial Sequence; identical to SEQ ID NO: 200779
  derived and/or modified sequence opt5 from neuraminidase__InfluenzaA__ADD74491

SEQ ID NO: 201268 - RNA, 1410 nt, Artificial Sequence; identical to SEQ ID NO: 199762
  derived and/or modified sequence opt5 from neuraminidase__InfluenzaA__ADD74501

SEQ ID NO: 201269 - RNA, 1410 nt, Artificial Sequence; identical to SEQ ID NO: 199762
  derived and/or modified sequence opt5 from neuraminidase__InfluenzaA__ADD74511

SEQ ID NO: 201270 - RNA, 1410 nt, Artificial Sequence; identical to SEQ ID NO: 200780
  derived and/or modified sequence opt5 from neuraminidase__InfluenzaA__ADD74521

SEQ ID NO: 201271 - RNA, 1410 nt, Artificial Sequence; identical to SEQ ID NO: 199762
  derived and/or modified sequence opt5 from neuraminidase__InfluenzaA__ADD74531

SEQ ID NO: 201272 - RNA, 1410 nt, Artificial Sequence
  derived and/or modified sequence opt5 from neuraminidase__InfluenzaA__ADD74551
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauuauggagcugucgccgugcugaaguacaacggcaucauuacagacaccaucaagagcuggagaaauaacauucuccggacacaagagucugagugugcgugcgugaauggguccuguuucaccgucaugacggauggaccgagcgacggccaggccucuuauaaaaucuuucgcauugaaaagggcaaaaucguuaagagcguggagaugaacgcucccaauuaccauuacgaagagugcuccuguuauccugauucuagcgagaucacaugcgugugcagagacaacuggcacggguccaaucggcccugggucagcuucaaccagaaucuggaauaccagauuggauauaucuguucuggcauuuuuggggauaacccucgccccaaugacaaaaccggauccugcggcccggugagcucuaacggggccaauggaguuaagggcuucuccuuuaaguacggcaacgggguguggaucggaagaacaaaaagcauuuccucucggaacggcuucgagaugaucugggauccuaauggguggaccggaaccgacaacaauuuuagcauuaagcaagacaucgucggcaucaacgaaugguccggguauucuggcagcuucgugcagcaucccgagcuuacaggacuggauuguauucgcccuugcuucuggguugaacucaucagaggccggcccaaagagaauacgauuuggaccuccgggagcucuaucuccuuuuguggagugaacagcgacacagucggcuggucuuggcccgauggggcugagcugccuuucaccauugacaaguga

SEQ ID NO: 201273 - RNA, 1410 nt, Artificial Sequence; identical to SEQ ID NO: 199762
  derived and/or modified sequence opt5 from neuraminidase__InfluenzaA__ADD74561

SEQ ID NO: 201274 - RNA, 1410 nt, Artificial Sequence; identical to SEQ ID NO: 199762
  derived and/or modified sequence opt5 from neuraminidase__InfluenzaA__ADD74571

SEQ ID NO: 201275 - RNA, 1410 nt, Artificial Sequence
  derived and/or modified sequence opt5 from neuraminidase__InfluenzaA__ADD74581
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacgcugugggcuggucuuggcccgauggggccgagcugccuuucacaaucgacaaguga

SEQ ID NO: 201276 - RNA, 1410 nt, Artificial Sequence; identical to SEQ ID NO: 199762
  derived and/or modified sequence opt5 from neuraminidase__InfluenzaA__ADD74591

SEQ ID NO: 201277 - RNA, 1410 nt, Artificial Sequence; identical to SEQ ID NO: 199762
  derived and/or modified sequence opt5 from neuraminidase__InfluenzaA__ADD74601

SEQ ID NO: 201278 - RNA, 1410 nt, Artificial Sequence
  derived and/or modified sequence opt5 from neuraminidase__InfluenzaA__ADD74611
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggaauuaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201279 - RNA, 1410 nt, Artificial Sequence; identical to SEQ ID NO: 199762
  derived and/or modified sequence opt5 from neuraminidase__InfluenzaA__ADD74621

SEQ ID NO: 201280 - RNA, 1410 nt, Artificial Sequence; identical to SEQ ID NO: 199762
  derived and/or modified sequence opt5 from neuraminidase__InfluenzaA__ADD74631

SEQ ID NO: 201281 - RNA, 1410 nt, Artificial Sequence; identical to SEQ ID NO: 199762
  derived and/or modified sequence opt5 from neuraminidase__InfluenzaA__ADD74641

SEQ ID NO: 201282 - RNA, 1410 nt, Artificial Sequence; identical to SEQ ID NO: 199762
  derived and/or modified sequence opt5 from neuraminidase__InfluenzaA__ADD74651

SEQ ID NO: 201283 - RNA, 1410 nt, Artificial Sequence; identical to SEQ ID NO: 201113
  derived and/or modified sequence opt5 from neuraminidase__InfluenzaA__ADD74661

SEQ ID NO: 201284 - RNA, 1410 nt, Artificial Sequence; identical to SEQ ID NO: 199762
  derived and/or modified sequence opt5 from neuraminidase__InfluenzaA__ADD74671

SEQ ID NO: 201285 - RNA, 1410 nt, Artificial Sequence; identical to SEQ ID NO: 199762
  derived and/or modified sequence opt5 from neuraminidase__InfluenzaA__ADD74681

SEQ ID NO: 201286 - RNA, 1410 nt, Artificial Sequence
  derived and/or modified sequence opt5 from neuraminidase__InfluenzaA__ADD74691
augaaccccaaucagaagaucauuaccaucggcagcgugugcaugacaauugggauggccaaccugauccuccaaauuggaaauaucaucuccauuuggaucugucacucuauucagcugggcaaccagaaucagaucgagacgugcaaccaaagcgucauuaccuacgaaaauaacacauggguuaaucagaccuaugugaacaucuccaauacaaacuucgcugccgggcagucuguggucagcgugaaacuugcgggaaauuccucucuguguccuguuagcggcugggcuauuuacuccaaggacaacagcaucagaaucgggucuaaaggagauguguuugucauucgggagccguucaucuccugcagcccccucgaaugucgcaccuuuuuccugacacagggcgcccuucugaaugacaagcauucuaacggcaccauuaaagauagauccccuuaucggacgcucaugagcugccccaucggggaggugccuucucccuacaacucccgcuuugaaagcguugccugguccgcuucugccugucacgacggaauuaauuggcugaccaucggcaucagcgggccugauaacggagcuguggccguccugaaguauaauggcauuaucacagacaccauuaaguccuggagaaacaauauccuccggacacaagagagcgagugcgcgugugugaacgggucuugcuucaccgugaugacggauggaccguccgacggccaggccagcuacaaaauuuuucgcaucgaaaagggcaaaaucgucaagucuguugagaugaaugcucccaacuaucauuacgaagaguguagcugcuacccugauuccucugagauuacaugcguguguagagacaauuggcacgggagcaaccggcccuggguguccuucaaucagaaccuggaauaucagaucggauacauuugcagcggcaucuuuggggauaauccucgccccaacgacaaaaccggaucuuguggcccggucuccagcaauggggccaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcuuacaggacuggauugcauccgcccuuguuucuggguggaacucauuagaggccggcccaaagagaacacgaucuggaccagcggguccagcauuucuuuuugcggaguuaauuccgacacagugggcuggagcuggcccgauggggcugagcugccuuucaccaucgacaaguga

SEQ ID NO: 201287 - RNA, 1410 nt, Artificial Sequence; identical to SEQ ID NO: 199762
  derived and/or modified sequence opt5 from neuraminidase__InfluenzaA__ADD74701

SEQ ID NO: 201288 - RNA, 1410 nt, Artificial Sequence; identical to SEQ ID NO: 199762
  derived and/or modified sequence opt5 from neuraminidase__InfluenzaA__ADD74711

SEQ ID NO: 201289 - RNA, 1410 nt, Artificial Sequence; identical to SEQ ID NO: 199762
  derived and/or modified sequence opt5 from neuraminidase__InfluenzaA__ADD74721

SEQ ID NO: 201290 - RNA, 1410 nt, Artificial Sequence; identical to SEQ ID NO: 199762
  derived and/or modified sequence opt5 from neuraminidase__InfluenzaA__ADD74731

SEQ ID NO: 201291 - RNA, 1410 nt, Artificial Sequence
  derived and/or modified sequence opt5 from neuraminidase__InfluenzaA__ADD74741
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaucuagcucccugugcccuguuagcggcugggcuaucuacucuaaggacaauuccaucagaauugggagcaaaggagauguguuugucauccgggagccguucauuucuuguagcccccucgaaugccgcaccuuuuuccugacacagggcgcccuucugaacgacaagcauuccaauggcaccaucaaagauagaucuccuuaucggacgcucauguccugucccauuggggaggugccuagccccuacaacucccgcuuugaaucuguugccuggagcgcuuccgccugccacgacggaaucaacuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaagggaagcugcggcccggucucuuccaacggggccaauggagugaagggcuucagcuuuaaauauggcaacgggguuuggaucggaagaaccaaguccauuucuagccggaacggcuucgagaugaucugggauccuaauggguggacaggaaccgacaacaauuuuuccaucaaacaagacauugugggcaucaacgaauggucuggguacagcggcuccuucguccagcaucccgagcuuaccggacuggauuguauucgcccuugcuucuggguggaacucaucagaggccggcccaaggagaauacaauuuggacgagcgggucuuccaucagcuuuuguggaguuaacucugacaccgugggcugguccuggcccgauggggcugagcugccuuucacaaucgacaaauga

SEQ ID NO: 201292 - RNA, 1410 nt, Artificial Sequence
  derived and/or modified sequence opt5 from neuraminidase__InfluenzaA__ADD74751
augaaccccaaucagaagaucauuaccaucggcagcgugugcaugacaauugggauggccaaccugauccuccaaauuggaaauaucaucuccauuuggaucucucacagcauucagcugggcaacaaaaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccugaaguaucagaucggauacauuuguucuggcaucuuuggggauaauccucgccccaacgacaagaaaggauccugcggcccggucagcucuaauggggccaacggagugaagggcuucuccuuuaaauauggcaacgggguuuggauuggaagaaccaagagcaucuccucucggaauggcuucgaaaugauuugggauccuaacggguggacaggaaccgacaauaacuuuagcaucaaacaggacaucgugggcaugaaugagugguccggguacucuggcagcuucguccaacaucccgaacuuaccggacuggauuguauucgcccuugcuucuggguggagcucaucagaggccggcccaaggaaaacacaauuuggacguccgggagcucuaucuccuuuuguggaguuaauagcgacaccgugggcuggucuuggcccgauggggcugagcugccuuucacaauugacaaauga

SEQ ID NO: 201293 - RNA, 1410 nt, Artificial Sequence
  derived and/or modified sequence opt5 from neuraminidase__InfluenzaA__ADD74761
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaaucaauagcgacacaguuggcuggucuuggcccgauggggcugagcugccuuucaccaucgacaaguga

SEQ ID NO: 201294 - RNA, 1410 nt, Artificial Sequence; identical to SEQ ID NO: 199762
  derived and/or modified sequence opt5 from neuraminidase__InfluenzaA__ADD74791

SEQ ID NO: 201295 - RNA, 1410 nt, Artificial Sequence; identical to SEQ ID NO: 200345
  derived and/or modified sequence opt5 from neuraminidase__InfluenzaA__ADD74811

SEQ ID NO: 201296 - RNA, 1410 nt, Artificial Sequence; identical to SEQ ID NO: 199762
  derived and/or modified sequence opt5 from neuraminidase__InfluenzaA__ADD74821

SEQ ID NO: 201297 - RNA, 1410 nt, Artificial Sequence
  derived and/or modified sequence opt5 from neuraminidase__InfluenzaA__ADD74831
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugccugaacggguccuguuucaccgucaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcgugugcagagacaauuggcacggguccaaccggcccuggguuagcuucaaucagaaccuugaauaucagauuggauacaucuguucuggcauuuuuggggauaauccucgccccaacgacaaaaccggauccugcggcccggugagcucuaauggggccaacggagugaagggcuucuccuuuaaguauggcaacggggucuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguucagcaucccgagcugacaggacucgauuguauucgcccuugcuucuggguggaacugaucagaggccggcccaaagagaacacgauuuggaccuccgggagcucuaucuccuuuuguggagucaauagcgacacagugggcuggucuuggcccgauggggcugagcuuccuuucaccaucgacaaguga

SEQ ID NO: 201298 - RNA, 1410 nt, Artificial Sequence; identical to SEQ ID NO: 199762
  derived and/or modified sequence opt5 from neuraminidase__InfluenzaA__ADD74841

SEQ ID NO: 201299 - RNA, 1410 nt, Artificial Sequence; identical to SEQ ID NO: 199762
  derived and/or modified sequence opt5 from neuraminidase__InfluenzaA__ADD74851

SEQ ID NO: 201300 - RNA, 1410 nt, Artificial Sequence; identical to SEQ ID NO: 200869
  derived and/or modified sequence opt5 from neuraminidase__InfluenzaA__ADD74861

SEQ ID NO: 201301 - RNA, 1410 nt, Artificial Sequence; identical to SEQ ID NO: 199762
  derived and/or modified sequence opt5 from neuraminidase__InfluenzaA__ADD74871

SEQ ID NO: 201302 - RNA, 1410 nt, Artificial Sequence; identical to SEQ ID NO: 199762
  derived and/or modified sequence opt5 from neuraminidase__InfluenzaA__ADD74881

SEQ ID NO: 201303 - RNA, 1410 nt, Artificial Sequence; identical to SEQ ID NO: 199762
  derived and/or modified sequence opt5 from neuraminidase__InfluenzaA__ADD74891

SEQ ID NO: 201304 - RNA, 1410 nt, Artificial Sequence; identical to SEQ ID NO: 199762
  derived and/or modified sequence opt5 from neuraminidase__InfluenzaA__ADD74901

SEQ ID NO: 201305 - RNA, 1410 nt, Artificial Sequence; identical to SEQ ID NO: 199762
  derived and/or modified sequence opt5 from neuraminidase__InfluenzaA__ADD74911

SEQ ID NO: 201306 - RNA, 1410 nt, Artificial Sequence; identical to SEQ ID NO: 199762
  derived and/or modified sequence opt5 from neuraminidase__InfluenzaA__ADD74921

SEQ ID NO: 201307 - RNA, 1410 nt, Artificial Sequence; identical to SEQ ID NO: 199762
  derived and/or modified sequence opt5 from neuraminidase__InfluenzaA__ADD74941

SEQ ID NO: 201308 - RNA, 1410 nt, Artificial Sequence
  derived and/or modified sequence opt5 from neuraminidase__InfluenzaA__ADD74961
augaaccccaaucagaagaucauuaccaucggcagcgugugcaugacaauugggauggccaaccugauccuccaaauuggaaauaucaucuccauuuggaucucucacagcauucagcugggcaaccagaaucagaucgggacguguaaccaauccgucauuaccuacgagaauaacacauggguuaaucauaccuaugugaacaucucuaauacaaacuucgcugccggacagagcguggucuccgugaaacuugcgggcaauucuagccugugcccuguuuccgggugggcuauuuacagcaaggacaacucugugagaaucggauccaaaggcgaugucuuugugauccgggaaccguucauuagcuguucuccccucgagugccgcaccuuuuuccugacacagggcgcccuucugaaugacaagcacuccaacgggaccaucaaagauagaagcccuuaucggacgcucaugucuugucccauuggagaaguuccuucccccuacaacagccgcuuugaguccguggccuggucugcuagcgccugccaugacggcaucaauuggcugaccauugggaucuccggaccugauaacggcgcugucgccgugcugaaguauaaugggaucauuacagacaccaucaagagcuggagaaacaauauucuccggacacaggaaucugagugugcgugcgugaacggauccuguuucaccgucaugacggauggcccgagcgacggccaagccucuuacaaaaucuuucgcauugagaaggggaaaaucguuaagagcguggaaaugaaugcucccaacuaucacuacgaggaaugcuccuguuacccugauucuagcgagaucacaugcgugugcagagacaauuggcauggauccaaccggcccugggucagcuucaaucagaaccuggaguaucagauuggcuacaucuguucugggauuuuuggagauaauccucgccccaacgacaaaaccggcuccugcgggccggugagcucuaauggagccaacggcguuaagggcuucuccuuuaaguaugggaacggaguguggaucggcagaacaaaaagcauuuccucucggaauggguucgaaaugaucugggauccuaacggauggaccggcaccgacaauaacuuuagcauuaagcaggacaucgucgggaucaaugagugguccggcuacucuggcagcuucgugcaacaccccgaacuuacaggacuggauuguauucgcccuugcuucuggguugagcucaucagagggcggcccaaagaaaacacgauuuggaccuccggaagcucuaucuccuuuuguggcgugaauagcgacacagucggguggucuuggcccgauggagcugagcugccuuucaccauugacaaguga

SEQ ID NO: 201309 - RNA, 1410 nt, Artificial Sequence; identical to SEQ ID NO: 199762
  derived and/or modified sequence opt5 from neuraminidase__InfluenzaA__ADD74971

SEQ ID NO: 201310 - RNA, 1410 nt, Artificial Sequence
  derived and/or modified sequence opt5 from neuraminidase__InfluenzaA__ADD74981
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggagcggcuucgagaugaucugggauccuaauggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccgaggagaauacgauuuggaccagcgggucuuccaucagcuuuuguggagugaacucugacacaguuggcugguccuggcccgauggggcugaacugccuuucaccaucgacaaauga

SEQ ID NO: 201311 - RNA, 1410 nt, Artificial Sequence; identical to SEQ ID NO: 199762
  derived and/or modified sequence opt5 from neuraminidase__InfluenzaA__ADD74991

SEQ ID NO: 201312 - RNA, 1410 nt, Artificial Sequence; identical to SEQ ID NO: 199762
  derived and/or modified sequence opt5 from neuraminidase__InfluenzaA__ADD75001

SEQ ID NO: 201313 - RNA, 1410 nt, Artificial Sequence
  derived and/or modified sequence opt5 from neuraminidase__InfluenzaA__ADD75011
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcgauccggucagcucuaauggcgccaacggggugaagggauucuccuuuaaguauggcaacggcguuuggauugggagaacaaaaagcaucuccucucggaauggauucgagaugauuugggacccuaacggcuggaccgggaccgacaauaacuuuagcaucaagcaagauaucgugggaauuaaugaaugguccggcuacucugggagcuucguccagcaucccgagcuuacaggccuggacuguauccgcccuugcuucuggguggaacucauuagaggacggcccaaagagaacacgaucuggaccuccggcagcucuauuuccuuuugugggguuaauagcgauacagugggauggucuuggcccgacggcgcugagcugccuuucaccaucgauaaguga

SEQ ID NO: 201314 - RNA, 1410 nt, Artificial Sequence; identical to SEQ ID NO: 201050
  derived and/or modified sequence opt5 from neuraminidase__InfluenzaA__ADD75031

SEQ ID NO: 201315 - RNA, 1410 nt, Artificial Sequence
  derived and/or modified sequence opt5 from neuraminidase__InfluenzaA__ADD75041
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaaaacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuaacuggcugaccaucggcaucuccgggccugauaauggagcuguggccguccugaaguauaacggcauuaucacagacaccauuaaaagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaauggagugaagggcuucuccuuuaaauauggcaacgggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 201316 - RNA, 1410 nt, Artificial Sequence; identical to SEQ ID NO: 199762
  derived and/or modified sequence opt5 from neuraminidase__InfluenzaA__ADD75051

SEQ ID NO: 201317 - RNA, 1410 nt, Artificial Sequence; identical to SEQ ID NO: 199762
  derived and/or modified sequence opt5 from neuraminidase__InfluenzaA__ADD75061

SEQ ID NO: 201318 - RNA, 1410 nt, Artificial Sequence; identical to SEQ ID NO: 199762
  derived and/or modified sequence opt5 from neuraminidase__InfluenzaA__ADD75071

SEQ ID NO: 201319 - RNA, 1410 nt, Artificial Sequence; identical to SEQ ID NO: 199762
  derived and/or modified sequence opt5 from neuraminidase__InfluenzaA__ADD75081

SEQ ID NO: 201320 - RNA, 1410 nt, Artificial Sequence
  derived and/or modified sequence opt5 from neuraminidase__InfluenzaA__ADD75091
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggagcggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 201321 - RNA, 1410 nt, Artificial Sequence; identical to SEQ ID NO: 199762
  derived and/or modified sequence opt5 from neuraminidase__InfluenzaA__ADD75101

SEQ ID NO: 201322 - RNA, 1410 nt, Artificial Sequence; identical to SEQ ID NO: 199762
  derived and/or modified sequence opt5 from neuraminidase__InfluenzaA__ADD75111

SEQ ID NO: 201323 - RNA, 1410 nt, Artificial Sequence; identical to SEQ ID NO: 199762
  derived and/or modified sequence opt5 from neuraminidase__InfluenzaA__ADD75121

SEQ ID NO: 201324 - RNA, 1410 nt, Artificial Sequence; identical to SEQ ID NO: 199762
  derived and/or modified sequence opt5 from neuraminidase__InfluenzaA__ADD75131

SEQ ID NO: 201325 - RNA, 1410 nt, Artificial Sequence; identical to SEQ ID NO: 199762
  derived and/or modified sequence opt5 from neuraminidase__InfluenzaA__ADD75141

SEQ ID NO: 201326 - RNA, 1410 nt, Artificial Sequence
  derived and/or modified sequence opt5 from neuraminidase__InfluenzaA__ADD75161
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcucuuaucggacgcucauguccuguccuaucggggaggugcccagcccuuacaacucccgcuuugaaucuguugccuggagcgcuuccgccugccacgacggaauuaauuggcugaccaucggcaucagcgggcccgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauauaaaaucggauacauuuguuccggcaucuuuggggauaauccccgcccuaacgacaagaccggaagcugcggccccgucucuuccaauggggccaacggagugaagggcuucagcuuuaaauauggcaacgggguuuggauuggaagaacaaaguccaucucuagccggaauggcuucgagaugauuugggauccgaacggguggaccggaaccgacaauaacuuuuccaucaaacaggacaucgugggcauuaaugaauggucuggguacagcggcuccuucguccaacauccugagcuuacaggacuggauuguauccgccccugcuucuggguggaacucauuagaggccggccuaaggagaacacgaucuggaccagcgggucuuccauuagcuuuuguggaguuaauucugacacagugggcugguccuggcccgauggggcugagcugcccuucaccaucgaccgcuga

SEQ ID NO: 201327 - RNA, 1410 nt, Artificial Sequence
  derived and/or modified sequence opt5 from neuraminidase__InfluenzaA__ADD84500
augaaccccaaucagaacaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaacggcaccauuaaggauagaagcccuuaucggacgcucaugucuugucccaucggggaggugccuucccccuacaauagccgcuuugaauccguugccuggucugcuagcgccugccacgacggaauuaacuggcugaccaucggcaucuccgggccugauaauggagcuguggccguccugaaauauaacggcauuaucacagacaccauuaagagcuggagaaauaacauccuccggacacaagagucugagugugcgugcgugaauggguccuguuucauugugaugaccgauggaccgagcgacggccaggccucuuacaagaucuuucgcaucgaaaaaggcaagauugucaaaagcguugagaugaacgcucccaauuaucauuacgaagagugcuccuguuacccugauucuagcgagaucacgugcgugugcagagacaacuggcacggguccaaucggcccugggugagcuucaaccagaaucuggaauaucagauuggauacaucuguucuggcauuuuuggggauaacccucgccccaaugacaagacaggauccugcggcccggucagcucuaacggggccaacggagugaaaggcuucuccuuuaaguauggcaaugggguuuggaucggaagaaccaagagcauuuccucucggaacggcuucgagaugaucugggauccuaauggguggacaggaaccgacaacaauuuuagcaucaaacaagacauugugggcaucaacgaaugguccggguacucuggcagcuucguccagcaucccgagcuuaccggacuggauuguauucgcccuugcuucuggguggaacucaucagaggccggcccaaggagaauacaauuuggacguccgggagcucuaucuccuuuuguggaguuaacagcgacaccgugggcuggucuuggcccgauggggcugagcugccuuucacaaucgacaaauga

SEQ ID NO: 201328 - RNA, 1410 nt, Artificial Sequence
  derived and/or modified sequence opt5 from neuraminidase__InfluenzaA__ADD84502
augaaccccaaucagaacaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaagggagauguguuugucauucgggagccguucaucagcuguucuccccucgaaugccgcaccuuuuuccugacacagggcgcccuucugaacgacaaacauuccaacggcaccauuaaggauagaagcccuuaucggacgcucaugucuugucccaucggggaggugccuucccccuacaauagccgcuuugaauccguugccuggucugcuagcgccugccacgacggaauuaacuggcugaccaucggcaucuccgggccugauaauggagcuguggccguccugaaauauaacggcauuaucacagacaccauuaagagcuggagaaauaacauccuccggacacaagagucugagugugcgugcgugaauggguccuguuucaccgugaugacggauggaccgagcgacggccaggccucuuacaagauuuuucgcaucgaaaaaggcaagaucgucaaaagcguugagaugaacgcucccaauuaucauuacgaagagugcuccuguuacccugauucuagcgagauuacaugcgugugcagagacaacuggcacggguccaaucggcccugggugagcuucaaccagaaucuggaauaucagaucggauacauuuguucuggcaucuuuggggauaacccucgccccaaugacaagaccggauccugcggcccggucagcucuaacggggccaacggagugaaaggcuucuccuuuaaguauggcaaugggguuuggauuggaagaacaaagagcaucuccucucggaacggcuucgagaugauuugggauccuaauggguggaccggaaccgacaacaauuuuagcaucaaacaagacaucgugggcauuaacgaaugguccggguacucuggcagcuucguccagcaucccgagcuuacaggacuggauuguauccgcccuugcuucuggguggaacucauuagaggccggcccaaggagaauacgaucuggaccuccgggagcucuauuuccuuuuguggaguuaacagcgacacagugggcuggucuuggcccgauggggcugagcugccuuucaccaucgacaaauga

SEQ ID NO: 201329 - RNA, 1410 nt, Artificial Sequence; identical to SEQ ID NO: 201328
  derived and/or modified sequence opt5 from neuraminidase__InfluenzaA__ADD84503

SEQ ID NO: 201330 - RNA, 1410 nt, Artificial Sequence
  derived and/or modified sequence opt5 from neuraminidase__InfluenzaA__ADD84504
augaaccccaaucagaacaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacuuuucucugugcccuguuagcggcugggcuauuuacuccaaggacaauagcaucagaaucgggucuaagggagauguguucgucauucgggagccguuuaucuccuguagcccccucgaaugccgcaccuucuuucugacacagggcgcccuucugaacgacaaacauucuaacggcaccauuaaggauagauccccuuaucggacgcucaugagcugucccaucggggaggugccuucucccuacaauucccgcuucgaaagcguugccugguccgcuucugccugccacgacggaauuaacuggcugaccaucggcaucagcgggccugauaauggagcuguggccguccugaaauauaacggcauuaucacagacaccauuaaguccuggagaaauaacauccuccggacacaagagagcgagugugcgugcgugaaugggucuuguuuuaccgugaugacggauggaccguccgacggccaggccagcuacaagauuuuccgcaucgaaaaaggcaagaucgucaaaucuguugagaugaacgcucccaauuaucauuacgaagagugcagcuguuacccugauuccucugagauuacaugcgugugcagagacaacuggcacgggagcaaucggcccuggguguccuuuaaccagaaucuggaauaucagaucggauacauuuguagcggcaucuucggggauaacccucgccccaaugacaagaccggaucuugcggcccggucuccagcaacggggccaacggagugaaaggcuuuucuuucaaguauggcaaugggguuuggauuggaagaacaaaguccaucagcucccggaacggcuuugagaugauuugggauccuaauggguggaccggaaccgacaacaauuucucuaucaaacaagacaucgugggcauuaacgaauggagcggguacuccggcucuuucguccagcaucccgagcuuacaggacuggauuguauccgcccuugcuuuuggguggaacucauuagaggccggcccaaggagaauacgaucuggaccagcggguccagcauuucuuucuguggaguuaacuccgacacagugggcuggagcuggcccgauggggcugagcugccuuuuaccaucgacaaauga

SEQ ID NO: 201331 - RNA, 1410 nt, Artificial Sequence; identical to SEQ ID NO: 201328
  derived and/or modified sequence opt5 from neuraminidase__InfluenzaA__ADD84505

SEQ ID NO: 201332 - RNA, 1410 nt, Artificial Sequence; identical to SEQ ID NO: 201328
  derived and/or modified sequence opt5 from neuraminidase__InfluenzaA__ADD84506

SEQ ID NO: 201333 - RNA, 1410 nt, Artificial Sequence
  derived and/or modified sequence opt5 from neuraminidase__InfluenzaA__ADD92528
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccgggcauucuggcagcuccguccagcaccccgagcuuacaggacuggauuguauccgcccuugcuucuggguggaacucauuagaggccggcccaaagagaacacgaucuggaccagcgggucuuccauuagcuucuguggaguuaauucugacacagugggcugguccuggcccgauggggcugagcugccuuuuaccaucgacaaguga

SEQ ID NO: 201334 - RNA, 1410 nt, Artificial Sequence; identical to SEQ ID NO: 200985
  derived and/or modified sequence opt5 from neuraminidase__InfluenzaA__ADD96769

SEQ ID NO: 201335 - RNA, 1410 nt, Artificial Sequence; identical to SEQ ID NO: 200985
  derived and/or modified sequence opt5 from neuraminidase__InfluenzaA__ADD96779

SEQ ID NO: 201336 - RNA, 1410 nt, Artificial Sequence; identical to SEQ ID NO: 200985
  derived and/or modified sequence opt5 from neuraminidase__InfluenzaA__ADD96789

SEQ ID NO: 201337 - RNA, 1410 nt, Artificial Sequence; identical to SEQ ID NO: 201113
  derived and/or modified sequence opt5 from neuraminidase__InfluenzaA__ADD96799

SEQ ID NO: 201338 - RNA, 1410 nt, Artificial Sequence; identical to SEQ ID NO: 199762
  derived and/or modified sequence opt5 from neuraminidase__InfluenzaA__ADD96809

SEQ ID NO: 201339 - RNA, 1410 nt, Artificial Sequence
  derived and/or modified sequence opt5 from neuraminidase__InfluenzaA__ADD96819
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaucuagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaagggaagcugcggcccggucucuuccaacggggccaauggagugaagggcuucagcuuuaaauauggcaacgggguuuggauuggaagaaccaaguccaucucuagccggaacggcuucgagaugauuugggauccuaauggguggacaggaaccgacaacaauuuuuccaucaaacaagacaucgugggcauuaacgaauggucuggguacagcggcuccuucguccagcaucccgagcuuaccggacuggauuguauccgcccuugcuucuggguggaacucauuagaggccggcccaaggagaauacaaucuggacgagcgggucuuccauuagcuuuuguggaguuaacucugacaccgugggcugguccuggcccgauggggcugagcugccuuucacaaucgacaaauga

SEQ ID NO: 201340 - RNA, 1410 nt, Artificial Sequence; identical to SEQ ID NO: 199762
  derived and/or modified sequence opt5 from neuraminidase__InfluenzaA__ADD96829

SEQ ID NO: 201341 - RNA, 1410 nt, Artificial Sequence; identical to SEQ ID NO: 199762
  derived and/or modified sequence opt5 from neuraminidase__InfluenzaA__ADD96839

SEQ ID NO: 201342 - RNA, 1410 nt, Artificial Sequence; identical to SEQ ID NO: 199762
  derived and/or modified sequence opt5 from neuraminidase__InfluenzaA__ADD96849

SEQ ID NO: 201343 - RNA, 1410 nt, Artificial Sequence; identical to SEQ ID NO: 199762
  derived and/or modified sequence opt5 from neuraminidase__InfluenzaA__ADD96859

SEQ ID NO: 201344 - RNA, 1410 nt, Artificial Sequence
  derived and/or modified sequence opt5 from neuraminidase__InfluenzaA__ADD96869
augaaccccaaucagaagaucauuaccaucggcagcgugugcaugacaauugggauggccaaccugauccuccaaauuggaaauaucaucuccauuuggaucucucacccuauucagcugggcaaccagaaucagaucgagacguguaaccaaagcgucauuaccuacgaaaauaacacauggguuaaucagaccuaugugaacaucuccaauacaaacuucgcugccgggcagucuguggucagcgugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggaaaaacaauauccucagaacacaagagagcgagugugcgugcgugaacgggucuuguuucaccgugaugacggauggacccuccgacggccaggccagcuacaagauuuuucggaucgaaaaaggcaagaucgucaaaucuguugagaugaaugcuccuaacuaucauuacgaagagugcagcuguuaccccgauuccucugagauuacaugcgugugccgcgacaauuggcacgggagcaacagaccuuggguguccuucaaucagaaccuggaauaucagaucggauacauuuguagcggcaucuuuggggauaauccccggccgaacgacaagaccggaucuugcggcccugucuccagcaauggggccaacggagugaagggcuucucuuuuaaauauggcaacgggguuuggauuggacgcacaaaguccaucagcuccagaaauggcuucgagaugauuugggaucccaacggguggaccggaaccgacaauaacuuuucuaucaaacaagacaucgugggcauuaaugaauggagcggguacuccggcucuuucguccagcauccugagcuuacaggacuggauuguauccggcccugcuucuggguggaacucauucgcggcagacccaaggagaacacgaucuggaccagcggguccagcauuucuuuuuguggaguuaauuccgacacagugggcuggagcuggccugauggggcugagcugccguucaccaucgacaaauga

SEQ ID NO: 201345 - RNA, 1410 nt, Artificial Sequence
  derived and/or modified sequence opt5 from neuraminidase__InfluenzaA__ADD96879
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucggcugccgcaccuuuuuccugacacagggcgcccuucugaaugacaagcauuccaacgggaccauuaaagauagaagcccuuaucggacgcucaugucuugucccaucggagaagugccuucccccuacaacagccgcuuugaguccguugccuggucugcuagcgccugccacgacggcauuaauuggcugaccaucgggaucuccggaccugauaacggcgcuguggccguccugaaguauaaugggauuaucacagacaccauuaagagcuggagaaacaauauccuccggacacaagaaucugagugugcgugcgugaacggauccuguuucaccgugaugacggauggcccgagcgacggccaggccucuuacaaaauuuuucgcaucgagaaggggaaaaucgucaagagcguugaaaugaaugcucccaacuaucauuacgaggaaugcuccuguuacccugauucuagcgagauuacaugcgugugcagagacaauuggcacggauccaaccggcccugggugagcuucaaucagaaccuggaguaucagaucggcuacauuuguucugggaucuuuggagauaauccucgccccaacgacaaaaccggcuccugcgggccggucagcucuaauggagccaacggcgugaagggcuucuccuuuaaguaugggaacggaguuuggauuggcagaacaaaaagcaucuccucucggaauggguucgaaaugauuugggauccuaacggauggaccggcaccgacaauaacuuuagcaucaagcaagacaucguggggauuaaugagugguccggcuacucuggcagcuucguccagcaucccgaacuuacaggacuggauuguauccgcccuugcuucuggguggagcucauuagagggcggcccaaagaaaacacgaucuggaccuccggaagcucuauuuccuuuuguggcguuaauagcgacacagugggguggucuuggcccgauggagcugagcugccuuucaccaucgacaaguga

SEQ ID NO: 201346 - RNA, 1410 nt, Artificial Sequence; identical to SEQ ID NO: 199762
  derived and/or modified sequence opt5 from neuraminidase__InfluenzaA__ADD96889

SEQ ID NO: 201347 - RNA, 1410 nt, Artificial Sequence; identical to SEQ ID NO: 200345
  derived and/or modified sequence opt5 from neuraminidase__InfluenzaA__ADD96899

SEQ ID NO: 201348 - RNA, 1410 nt, Artificial Sequence; identical to SEQ ID NO: 199762
  derived and/or modified sequence opt5 from neuraminidase__InfluenzaA__ADD96909

SEQ ID NO: 201349 - RNA, 1410 nt, Artificial Sequence; identical to SEQ ID NO: 199762
  derived and/or modified sequence opt5 from neuraminidase__InfluenzaA__ADD96919

SEQ ID NO: 201350 - RNA, 1410 nt, Artificial Sequence; identical to SEQ ID NO: 199762
  derived and/or modified sequence opt5 from neuraminidase__InfluenzaA__ADD96929

SEQ ID NO: 201351 - RNA, 1410 nt, Artificial Sequence; identical to SEQ ID NO: 199762
  derived and/or modified sequence opt5 from neuraminidase__InfluenzaA__ADD96939

SEQ ID NO: 201352 - RNA, 1410 nt, Artificial Sequence; identical to SEQ ID NO: 199762
  derived and/or modified sequence opt5 from neuraminidase__InfluenzaA__ADD96959

SEQ ID NO: 201353 - RNA, 1410 nt, Artificial Sequence; identical to SEQ ID NO: 199762
  derived and/or modified sequence opt5 from neuraminidase__InfluenzaA__ADD96969

SEQ ID NO: 201354 - RNA, 1410 nt, Artificial Sequence
  derived and/or modified sequence opt5 from neuraminidase__InfluenzaA__ADD96989
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcucuuaucggacgcucauguccuguccuaucggggaggugcccagcccuuacaacucccgcuuugaaucuguugccuggagcgcuuccgccugccacgacggaauuaauuggcugaccaucggcaucagcgggcccgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 201355 - RNA, 1410 nt, Artificial Sequence
  derived and/or modified sequence opt5 from neuraminidase__InfluenzaA__ADD97038
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaucggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccggcggguggucuuggcccgauggagcugagcugccuuucacaaucgacaaguga

SEQ ID NO: 201356 - RNA, 1410 nt, Artificial Sequence; identical to SEQ ID NO: 199762
  derived and/or modified sequence opt5 from neuraminidase__InfluenzaA__ADD97048

SEQ ID NO: 201357 - RNA, 1410 nt, Artificial Sequence; identical to SEQ ID NO: 199762
  derived and/or modified sequence opt5 from neuraminidase__InfluenzaA__ADD97058

SEQ ID NO: 201358 - RNA, 1410 nt, Artificial Sequence; identical to SEQ ID NO: 199762
  derived and/or modified sequence opt5 from neuraminidase__InfluenzaA__ADD97069

SEQ ID NO: 201359 - RNA, 1410 nt, Artificial Sequence; identical to SEQ ID NO: 199762
  derived and/or modified sequence opt5 from neuraminidase__InfluenzaA__ADD97126

SEQ ID NO: 201360 - RNA, 1410 nt, Artificial Sequence; identical to SEQ ID NO: 199762
  derived and/or modified sequence opt5 from neuraminidase__InfluenzaA__ADD97164

SEQ ID NO: 201361 - RNA, 1410 nt, Artificial Sequence; identical to SEQ ID NO: 199762
  derived and/or modified sequence opt5 from neuraminidase__InfluenzaA__ADD97174

SEQ ID NO: 201362 - RNA, 1410 nt, Artificial Sequence; identical to SEQ ID NO: 199762
  derived and/or modified sequence opt5 from neuraminidase__InfluenzaA__ADD97184

SEQ ID NO: 201363 - RNA, 1410 nt, Artificial Sequence
  derived and/or modified sequence opt5 from neuraminidase__InfluenzaA__ADD97194
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaaugcuaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggccgagcugccuuucacaaucgacaaguga

SEQ ID NO: 201364 - RNA, 1410 nt, Artificial Sequence; identical to SEQ ID NO: 201354
  derived and/or modified sequence opt5 from neuraminidase__InfluenzaA__ADD97204

SEQ ID NO: 201365 - RNA, 1410 nt, Artificial Sequence; identical to SEQ ID NO: 199762
  derived and/or modified sequence opt5 from neuraminidase__InfluenzaA__ADD97214

SEQ ID NO: 201366 - RNA, 1410 nt, Artificial Sequence; identical to SEQ ID NO: 199762
  derived and/or modified sequence opt5 from neuraminidase__InfluenzaA__ADD97224

SEQ ID NO: 201367 - RNA, 1410 nt, Artificial Sequence; identical to SEQ ID NO: 199762
  derived and/or modified sequence opt5 from neuraminidase__InfluenzaA__ADD97234

SEQ ID NO: 201368 - RNA, 1410 nt, Artificial Sequence; identical to SEQ ID NO: 199762
  derived and/or modified sequence opt5 from neuraminidase__InfluenzaA__ADD97244

SEQ ID NO: 201369 - RNA, 1410 nt, Artificial Sequence; identical to SEQ ID NO: 199762
  derived and/or modified sequence opt5 from neuraminidase__InfluenzaA__ADD97254

SEQ ID NO: 201370 - RNA, 1410 nt, Artificial Sequence; identical to SEQ ID NO: 199762
  derived and/or modified sequence opt5 from neuraminidase__InfluenzaA__ADD97264

SEQ ID NO: 201371 - RNA, 1410 nt, Artificial Sequence; identical to SEQ ID NO: 199762
  derived and/or modified sequence opt5 from neuraminidase__InfluenzaA__ADD97274

SEQ ID NO: 201372 - RNA, 1410 nt, Artificial Sequence
  derived and/or modified sequence opt5 from neuraminidase__InfluenzaA__ADD97284
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucugcaauacaaacuucgcugccgggcagucuguggucagcgugaaacuugcgggaaauuccucucuguguccuguuagcggcugggcuauuuacuccaaggacaacagcaucagaaucgggucuaaaggagauguguuugucauucgggagccguucaucuccugcagcccccucgaaugucgcaccuuuuuccugacacagggcgcccuucugaaugacaagcauucuaacggcaccauuaaagauagauccccuuaucggacgcucaugagcugccccaucggggaggugccuucucccuacaacucccgcuuugaaagcguugccugguccgcuucugccugucacgacggaauuaauuggcugaccaucggcaucagcgggccugauaacggagcuguggccguccugaaguauaauggcauuaucacagacaccauuaaguccuggagaaacaauauccuccggacacaagagagcgagugcgcgugugugaacgggucuugcuucaccgugaugacggauggaccguccgacggccaggccagcuacaaaauuuuucgcaucgaaaagggcaaaaucgucaagucuguugagaugaaugcucccaacuaucauuacgaagaguguagcugcuacccugauuccucugagauuacaugcguguguagagacaauuggcacgggagcaaccggcccuggguguccuucaaucagaaccuggaauaucagaucggauacauuugcagcggcaucuuuggggauaauccucgccccaacgacaaaaccggaucuuguggcccggucuccagcaauggggccaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcuuacaggacuggauugcauccgcccuuguuucuggguggaacucauuagaggccggcccaaagagaacacgaucuggaccagcggguccagcauuucuuuuugcggaguuaauuccgacacagugggcuggagcuggcccgauggggcugagcugccuuucaccaucgacaaguga

SEQ ID NO: 201373 - RNA, 1410 nt, Artificial Sequence; identical to SEQ ID NO: 199762
  derived and/or modified sequence opt5 from neuraminidase__InfluenzaA__ADD97294

SEQ ID NO: 201374 - RNA, 1410 nt, Artificial Sequence
  derived and/or modified sequence opt5 from neuraminidase__InfluenzaA__ADD97314
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcacaaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 201375 - RNA, 1410 nt, Artificial Sequence; identical to SEQ ID NO: 199762
  derived and/or modified sequence opt5 from neuraminidase__InfluenzaA__ADD97334

SEQ ID NO: 201376 - RNA, 1410 nt, Artificial Sequence; identical to SEQ ID NO: 199762
  derived and/or modified sequence opt5 from neuraminidase__InfluenzaA__ADD97344

SEQ ID NO: 201377 - RNA, 1410 nt, Artificial Sequence; identical to SEQ ID NO: 199762
  derived and/or modified sequence opt5 from neuraminidase__InfluenzaA__ADD97354

SEQ ID NO: 201378 - RNA, 1410 nt, Artificial Sequence
  derived and/or modified sequence opt5 from neuraminidase__InfluenzaA__ADD97384
augaaccccaaucagaagaucauuaccaucggcagcgugugcaugacaauugggauggccaaccugauccuccaaauuggaaauaucaucuccauuuggaucucucacacgauucagcugggcaaccagaaucagaucgagaccuguaaccaaagcgucauuacauacgaaaauaacaccuggguuaaucagacauaugugaacaucuccaauaccaacuucgcugccgggcagucuguggucagcgugaaacuugcgggaaauuccucucugugcccuguuagcggcugggcuauuuacuccaaggacaacagcaucagaaucgggucuaaaggagauguguuugucauucgggagccguucaucuccuguagcccccucgaaugccgcacauuuuuccugacccagggcgcccuucugaaugacaagcauucuaacggcacgauuaaagauagauccccuuaucggacccucaugagcugucccaucggggaggugccuucucccuacaacucccgcuuugaaagcguugccugguccgcuucugccugccacgacggaauuaauuggcugacaaucggcaucagcgggccugauaacggagcuguggccguccugaaguauaauggcauuaucaccgacacaauuaaguccuggagaaacaauauccuccggacccaagagagcgagugugcgugcgugaacgggucuuguuucacggugaugacagauggaccguccgacggccaggccagcuacaaaauuuuucgcaucgaaaagggcaaaaucgucaagucuguugagaugaaugcucccaacuaucauuacgaagagugcagcuguuacccugauuccucugagauuaccugcgugugcagagacaauuggcacgggagcaaccggcccuggguguccuucaaucagaaccuggaauaucagaucggauacauuuguagcggcaucuuuggggauaauccucgccccaacgacaaaacaggaucuugcggcccggucuccagcaauggggccaacggagugaagggcuucucuuuuaaguauggcaacgggguuuggauuggaagaaccaaauccaucagcucccggaauggcuucgagaugauuugggauccuaacggguggaccggaacagacaauaacuuuucuaucaagcaagacaucgugggcauuaaugaauggagcggguacuccggcucuuucguccagcaucccgagcuuacgggacuggauuguauccgcccuugcuucuggguggaacucauuagaggccggcccaaagagaacaccaucuggacaagcggguccagcauuucuuuuuguggaguuaauuccgacaccgugggcuggagcuggcccgauggggcugagcugccuuucacaaucgacaaguga

SEQ ID NO: 201379 - RNA, 1410 nt, Artificial Sequence
  derived and/or modified sequence opt5 from neuraminidase__InfluenzaA__ADD97394
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagccuguggucagcgugaaacuugcgggaaauuccucucugugcccgguuaacggcugggcuauuuacagcaaggacaauuccaucagaaucgggagcaaaggagauguguuugucauucgggagcccuucaucucuuguuccccucucgaaugccgcaccuuuuuccugacacagggcgcccuucugaacgacaagcauagcaacggcaccauuaaagauagaucucccuaucggacgcucauguccuguccuaucggggaggugcccagcccuuacaauucucgcuuugaauccguugccuggagcgcuuccgccugccacgacggaauuaacuggcugaccaucggcaucucugggccggauaauggagcuguggccguccugaaguauaacggcauuaucacagacaccauuaagagcuggagaaauaacauccuccggacacaagaguccgagugugcgugcgugaaugggagcuguuucaccgugaugacggauggacccucugacggccaggccuccuacaaaauuuuucgcaucgaaaagggcaaaaucgucaagagcguugagaugaacgcuccuaauuaucauuacgaagagugcucuuguuaccccgauagcuccgagauuacaugcgugugcagagacaacuggcacgggucuaaucggccuugggugagcuucaaccagaaucuggaauaucagaucggauacauuuguuccggcaucuuuggggauaacccccgcccgaaugacaaaaccggaagcugcggcccugucucuuccaacggggccaacggagugaagggcuucagcuuuaaguauggcaaugggguuuggauuggaagaacaaaaucuaucuccagccggaacggcuucgagaugauuugggaucccaauggguggaccggaaccgacaacaauuuuuccaucaagcaagacaucgugggcauuaacgaauggucuggguacagcggcuccuucguccagcauccugagcuuacaggacuggauuguauccgccccugcuucuggguggaacucauuagaggccggcccaaagagaauacgaucuggaccucugggagcuccauuagcuuuuguggaguuaacucugacacagugggcugguccuggccugauggggcugagcugccguucaccaucgacaaguga

SEQ ID NO: 201380 - RNA, 1410 nt, Artificial Sequence; identical to SEQ ID NO: 199762
  derived and/or modified sequence opt5 from neuraminidase__InfluenzaA__ADD97404

SEQ ID NO: 201381 - RNA, 1410 nt, Artificial Sequence; identical to SEQ ID NO: 199762
  derived and/or modified sequence opt5 from neuraminidase__InfluenzaA__ADD97424

SEQ ID NO: 201382 - RNA, 1410 nt, Artificial Sequence; identical to SEQ ID NO: 199762
  derived and/or modified sequence opt5 from neuraminidase__InfluenzaA__ADD97434

SEQ ID NO: 201383 - RNA, 1410 nt, Artificial Sequence; identical to SEQ ID NO: 199762
  derived and/or modified sequence opt5 from neuraminidase__InfluenzaA__ADD97444

SEQ ID NO: 201384 - RNA, 1410 nt, Artificial Sequence
  derived and/or modified sequence opt5 from neuraminidase__InfluenzaA__ADD97454
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuauuuccggcugggcuaucuacagcaaggacaacucuaucagaauuggguccaaaggagauguuuuugugauccgggagccguucauuagcuguucuccccucgaaugccgcaccuuuuuccugacacagggcgcccuucuguccgacaagcauagcaauggcaccaucaaagauagaucuccuuaucggacgcucauguccugucccauuggggaggucccuagccccuacaacucccgcuuugaaucuguggccuggagcgcuuccgccugccacgacggaaucaacuggcugaccaucggcauuagcgggccugauaauggagcuguugccgugcugaaguauaacggcaucauuacagacaccaucaagucuuggagaaauaacauucuccggacacaagaguccgagugugcgugcgucaaugggagcuguuucaccgugaugacggauggaccgucugacggccaggccagcuacaaaaucuuucgcaucgaaaagggcaaaauugugaaguccgucgagaugaacgcucccaauuaucauuacgaagagugcucuuguuacccugauagcuccgagaucacaugcguuugcagagacaacuggcacgggagcaaucggcccugggugucuuucaaccagaaucuggaauaucagauuggauacaucuguuccggcauuuuuggggauaacccucgccccaaugacaaaaccggaagcugcggcccggugucuuccaacggggccaauggagucaagggcuucagcuuuaaguauggcaacgggguguggaucggaagaacaaaauccauuucuagccggaacggcuucgagaugaucugggauccuaauggguggaccggaaccgacaacaauuuuuccaucaagcaagacauuguuggcaucaacgaauggucuggguacagcggcuccuucgugcagcaucccgagcuuacaggacuggauuguauucgcccuugcuucugggucgaacucaucagaggccggcccaaagagaauacgauuuggaccagcgggucuuccaucagcuuuuguggagugaacucugacacaguuggcugguccuggcccgauggggcugagcugccuuucaccaucgacaaguga

SEQ ID NO: 201385 - RNA, 1410 nt, Artificial Sequence
  derived and/or modified sequence opt5 from neuraminidase__InfluenzaA__ADD97464
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcacaaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 201386 - RNA, 1410 nt, Artificial Sequence; identical to SEQ ID NO: 199762
  derived and/or modified sequence opt5 from neuraminidase__InfluenzaA__ADD97474

SEQ ID NO: 201387 - RNA, 1410 nt, Artificial Sequence; identical to SEQ ID NO: 199762
  derived and/or modified sequence opt5 from neuraminidase__InfluenzaA__ADD97484

SEQ ID NO: 201388 - RNA, 1410 nt, Artificial Sequence
  derived and/or modified sequence opt5 from neuraminidase__InfluenzaA__ADD97494
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucccuccgaaugccgcaccuuuuuccucacacagggcgcccugcuuaaugacaagcauagcaacggcaccauuaaagauagaucuccuuaucggacgcugauguccugucccaucggggaggugccuagccccuacaacucccgcuuugaaucuguugccuggagcgcuuccgccugccacgacggaauuaauuggcucaccaucggcaucagcgggccugauaacggagcuguggccguccugaaguauaauggcauuaucacagacaccauuaagucuuggagaaacaauauccugcggacacaagaguccgagugugcgugcgugaacgggagcuguuucaccgugaugacggauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacaugcgugugcagagacaauuggcacgggagcaaccggcccugggugucuuucaaucagaaccucgaauaucagaucggauacauuuguuccggcaucuuuggggauaauccucgccccaacgacaaaaccggaagcugcggcccggucucuuccaauggggccaacggagugaagggcuucagcuuuaaguauggcaacgggguuuggauuggaagaacaaaauccaucucuagccggaauggcuucgagaugauuugggauccuaacggguggaccggaaccgacaauaacuuuuccaucaagcaagacaucgugggcauuaaugaauggucuggguacagcggcuccuucguccagcaucccgagcugacaggacuugauuguauccgcccuugcuucuggguggaacugauuagaggccggcccaaagagaacacgaucuggaccagcgggucuuccauuagcuuuuguggaguuaauucugacacagugggcugguccuggcccgauggggcugagcucccuuucaccaucgacaaguga

SEQ ID NO: 201389 - RNA, 1410 nt, Artificial Sequence; identical to SEQ ID NO: 199762
  derived and/or modified sequence opt5 from neuraminidase__InfluenzaA__ADD97504

SEQ ID NO: 201390 - RNA, 1410 nt, Artificial Sequence; identical to SEQ ID NO: 199762
  derived and/or modified sequence opt5 from neuraminidase__InfluenzaA__ADD97514

SEQ ID NO: 201391 - RNA, 1410 nt, Artificial Sequence; identical to SEQ ID NO: 201374
  derived and/or modified sequence opt5 from neuraminidase__InfluenzaA__ADD97534

SEQ ID NO: 201392 - RNA, 1410 nt, Artificial Sequence; identical to SEQ ID NO: 199762
  derived and/or modified sequence opt5 from neuraminidase__InfluenzaA__ADD97544

SEQ ID NO: 201393 - RNA, 1410 nt, Artificial Sequence; identical to SEQ ID NO: 199762
  derived and/or modified sequence opt5 from neuraminidase__InfluenzaA__ADD97554

SEQ ID NO: 201394 - RNA, 1410 nt, Artificial Sequence; identical to SEQ ID NO: 201378
  derived and/or modified sequence opt5 from neuraminidase__InfluenzaA__ADD97564

SEQ ID NO: 201395 - RNA, 1410 nt, Artificial Sequence; identical to SEQ ID NO: 199762
  derived and/or modified sequence opt5 from neuraminidase__InfluenzaA__ADD97574

SEQ ID NO: 201396 - RNA, 1410 nt, Artificial Sequence; identical to SEQ ID NO: 199762
  derived and/or modified sequence opt5 from neuraminidase__InfluenzaA__ADD97584

SEQ ID NO: 201397 - RNA, 1410 nt, Artificial Sequence
  derived and/or modified sequence opt5 from neuraminidase__InfluenzaA__ADD97681
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagauuaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaaucaauagcgacacaguuggcuggucuuggcccgauggggcugagcugccuuucaccauugacaaguga

SEQ ID NO: 201398 - RNA, 1410 nt, Artificial Sequence; identical to SEQ ID NO: 201354
  derived and/or modified sequence opt5 from neuraminidase__InfluenzaA__ADD97691

SEQ ID NO: 201399 - RNA, 1410 nt, Artificial Sequence; identical to SEQ ID NO: 200899
  derived and/or modified sequence opt5 from neuraminidase__InfluenzaA__ADD97701

SEQ ID NO: 201400 - RNA, 1410 nt, Artificial Sequence; identical to SEQ ID NO: 199762
  derived and/or modified sequence opt5 from neuraminidase__InfluenzaA__ADD97891

SEQ ID NO: 201401 - RNA, 1410 nt, Artificial Sequence; identical to SEQ ID NO: 199762
  derived and/or modified sequence opt5 from neuraminidase__InfluenzaA__ADD97901

SEQ ID NO: 201402 - RNA, 1410 nt, Artificial Sequence; identical to SEQ ID NO: 199762
  derived and/or modified sequence opt5 from neuraminidase__InfluenzaA__ADD97911

SEQ ID NO: 201403 - RNA, 1410 nt, Artificial Sequence; identical to SEQ ID NO: 199762
  derived and/or modified sequence opt5 from neuraminidase__InfluenzaA__ADD97921

SEQ ID NO: 201404 - RNA, 1410 nt, Artificial Sequence; identical to SEQ ID NO: 199762
  derived and/or modified sequence opt5 from neuraminidase__InfluenzaA__ADD97931

SEQ ID NO: 201405 - RNA, 1410 nt, Artificial Sequence; identical to SEQ ID NO: 200529
  derived and/or modified sequence opt5 from neuraminidase__InfluenzaA__ADD97941

SEQ ID NO: 201406 - RNA, 1410 nt, Artificial Sequence
  derived and/or modified sequence opt5 from neuraminidase__InfluenzaA__ADD97951
augaaccccaaucagaagaucauuaccaucagcuccgugugcaugacaauuggcauggccaaccugauccuccaaauugggaauaucaucucuauuuggaucagccacuccauucagcugggaaaccagaaucagaucgagacguguaaccaaucugucauuaccuacgaaaauaacacauggguuaaucagaccuaugugaacaucagcaauacaaacuucgcugccggccaguccguggucucugugaaacuugcggggaauagcucccugugcccuguuagcggaugggcuauuuacucuaaggacaacuccaucagaaucggcagcaaaggggauguguuugucauucgggagccguucaucucuuguucuccccucgaaugccgcaccuuuuuccugacacagggagcccuucugaaugacaagcauagcaacggcaccauuaaagauagaucuccuuaucggacgcucauguccugucccaucggcgaggugccuagccccuacaacucccgcuuugaaucuguugccuggagcgcuuccgccugccacgacgggauuaauuggcugaccaucggaaucagcggcccugauaacggggcuguggccguccugaaguauaauggaauuaucacagacaccauuaagucuuggagaaacaauauccuccggacacaagaguccgagugugcgugcgugaacggcagcuguuucaccgugaugacggaugggccgucugacggacaggccagcuacaaaauuuuucgcaucgaaaagggcaaaaucgucaaguccguugagaugaaugcucccaacuaucauuacgaagagugcucuuguuacccugauagcuccgagauuacaugcgugugcagagacaauuggcacggcagcaaccggcccugggugucuuucaaucagaaccuggaauaucagaucggguacauuuguuccggaaucuuuggcgauaauccucgccccaacgacaaaaccgggagcugcggaccggucucuuccaauggcgccaacggggugaagggauucagcuuuaaguauggcaacggcguuuggauugggagaacaaaauccaucucuagccggaauggauucgagaugauuugggauccuaacggcuggaccgggaccgacaauaacuuuuccaucaagcaagacaucgugggaauuaaugaauggucuggcuacagcggguccuucguccagcaucccgagcuuacaggccuggauuguauccgcccuugcuucuggguggaacucauuagaggacggcccaaagagaacacgaucuggaccagcggcuccuccauuagcuuuugugggguuaauucugacacagugggaugguccuggcccgauggcgcugagcugccuuucaccaucgacaaguga

SEQ ID NO: 201407 - RNA, 1410 nt, Artificial Sequence
  derived and/or modified sequence opt5 from neuraminidase__InfluenzaA__ADD97961
augaaccccaaucagaagaucauuaccaucggcagcgugugcaugacaauugggauggucaaccugauccuccaaauuggaaauaucaucuccauuuggaucucucacagcauucagcugggcaaccagaaucagaucgagacguguaaccaauccguuauuaccuacgaaaauaacacaugggugaaucagaccuaugugaacaucucuaauacaaacuucgccgcugggcagagcgucguguccguuaaacuugccggaaaugcgucucugugcccugugagcggcugggcuauuuacuccaaggacaacagcaucagaaucgggucuaaaggagaugucuuugugauucgggagccguucaucuccuguagcccccucgaaugccgcaccuuuuuccugacacagggcgcccuucugaaugacaagcauucuaacggcaccauuaaagauagauccccuuaucggacgcucaugagcugucccaucggggagguuccuucucccuacaacucccgcuuugaaagcguggccugguccgcuucugccugccacgacggaauuaauuggcugaccaucggcaucagcgggccugauaacggagcugucgccgugcugaaguauaauggcauuaucacagacaccauuaaguccuggagaaacaauauccuccggacacaagagagcgagugugcgugcgugaacgggucuuguuucaccgucaugacggauggaccguccgacggccaggccagcuacaaaauuuuucgcaucgaaaagggcaaaaucguuaagucuguggagaugaaugcucccaacuaucauuacgaagagugcagcuguuacccugauuccucugagauuacaugcgugugcagagacaauuggcacgggagcaaccggcccugggucuccuucaaucagaaccuggaauaucagaucggauacauuuguagcggcaucuuuggggauaauccucgccccaacgacaaaaccggaucuugcggcccgguguccagcaauggggccaacggaguuaagggcuucucuuuuaaguauggcaacgggguguggauuggaagaacaaaauccaucagcucccggaauggcuucgagaugauuugggauccuaacggguggaccggaaccgacaauaacuuuucuaucaagcaagacaucgucggcauuaaugaauggagcggguacuccggcucuuucgugcagcaucccgagcuuacaggacuggauuguauccgcccuugcuucuggguugaacucauuagaggccggcccaaagagaacacgaucuggaccagcggguccagcauuucuuuuuguggagucaauuccgacacagugggcuggagcuggcccgauggggcugagcugccuuucaccaucgacaaguga

SEQ ID NO: 201408 - RNA, 1410 nt, Artificial Sequence; identical to SEQ ID NO: 201354
  derived and/or modified sequence opt5 from neuraminidase__InfluenzaA__ADD97971

SEQ ID NO: 201409 - RNA, 1410 nt, Artificial Sequence; identical to SEQ ID NO: 199762
  derived and/or modified sequence opt5 from neuraminidase__InfluenzaA__ADD97981

SEQ ID NO: 201410 - RNA, 1410 nt, Artificial Sequence
  derived and/or modified sequence opt5 from neuraminidase__InfluenzaA__ADD97991
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaucggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201411 - RNA, 1410 nt, Artificial Sequence
  derived and/or modified sequence opt5 from neuraminidase__InfluenzaA__ADD98001
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccgucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 201412 - RNA, 1410 nt, Artificial Sequence; identical to SEQ ID NO: 199762
  derived and/or modified sequence opt5 from neuraminidase__InfluenzaA__ADD98011

SEQ ID NO: 201413 - RNA, 1410 nt, Artificial Sequence; identical to SEQ ID NO: 199762
  derived and/or modified sequence opt5 from neuraminidase__InfluenzaA__ADD98031

SEQ ID NO: 201414 - RNA, 1410 nt, Artificial Sequence; identical to SEQ ID NO: 201411
  derived and/or modified sequence opt5 from neuraminidase__InfluenzaA__ADD98041

SEQ ID NO: 201415 - RNA, 1410 nt, Artificial Sequence; identical to SEQ ID NO: 199762
  derived and/or modified sequence opt5 from neuraminidase__InfluenzaA__ADD98051

SEQ ID NO: 201416 - RNA, 1410 nt, Artificial Sequence; identical to SEQ ID NO: 199762
  derived and/or modified sequence opt5 from neuraminidase__InfluenzaA__ADD98061

SEQ ID NO: 201417 - RNA, 1410 nt, Artificial Sequence; identical to SEQ ID NO: 199762
  derived and/or modified sequence opt5 from neuraminidase__InfluenzaA__ADD98071

SEQ ID NO: 201418 - RNA, 1410 nt, Artificial Sequence; identical to SEQ ID NO: 199762
  derived and/or modified sequence opt5 from neuraminidase__InfluenzaA__ADD98081

SEQ ID NO: 201419 - RNA, 1410 nt, Artificial Sequence; identical to SEQ ID NO: 199762
  derived and/or modified sequence opt5 from neuraminidase__InfluenzaA__ADD98091

SEQ ID NO: 201420 - RNA, 1410 nt, Artificial Sequence; identical to SEQ ID NO: 200588
  derived and/or modified sequence opt5 from neuraminidase__InfluenzaA__ADD98101

SEQ ID NO: 201421 - RNA, 1410 nt, Artificial Sequence
  derived and/or modified sequence opt5 from neuraminidase__InfluenzaA__ADD98111
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcauccuuggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuuuguccagcaucccgagcugacaggacucgauuguauccgcccuugcuucuggguggaacugauuagaggccggcccaaagagaacacgaucuggaccuccgggagcucuauuuccuucuguggaguuaauagcgacacagugggcuggucuuggcccgauggggcugagcuuccuuuuaccaucgacaaguga

SEQ ID NO: 201422 - RNA, 1410 nt, Artificial Sequence; identical to SEQ ID NO: 199762
  derived and/or modified sequence opt5 from neuraminidase__InfluenzaA__ADD98121

SEQ ID NO: 201423 - RNA, 1410 nt, Artificial Sequence; identical to SEQ ID NO: 199762
  derived and/or modified sequence opt5 from neuraminidase__InfluenzaA__ADD98131

SEQ ID NO: 201424 - RNA, 1410 nt, Artificial Sequence; identical to SEQ ID NO: 199762
  derived and/or modified sequence opt5 from neuraminidase__InfluenzaA__ADD98141

SEQ ID NO: 201425 - RNA, 1410 nt, Artificial Sequence; identical to SEQ ID NO: 199762
  derived and/or modified sequence opt5 from neuraminidase__InfluenzaA__ADD98151

SEQ ID NO: 201426 - RNA, 1410 nt, Artificial Sequence
  derived and/or modified sequence opt5 from neuraminidase__InfluenzaA__ADD98161
augaaccccaaucagaagaucauuaccaucggcagcgugugcaugacaauugggauggccaaccugauccuccaaauuggaaauaucaucuccauuuggaucucucacacgauucagcugggcaaccagaaucagaucgagaccuguaaccaaagcgucauuacauacgaaaauaacaccuggguuaaucagacauaugugaacaucuccaauaccaacuucgcugccgggcagucuguggucagcgugaaacuugcgggaaauuccucucugugcccuguuagcggcugggcuauuuacuccaaggacaacagcaucagaaucgggucuaaaggagauguguuugucauucgggagccguucaucuccuguagcccccucgaaugccgcacauuuuuccugacccagggcgcccuucugaaugacaagcauucuaacggcacgauuaaagauagauccccuuaucggacccucaugagcugucccaucggggaggugccuucucccuacaacucccgcuuugaaagcguugccugguccgcuucugccugccacgacggaauuaauuggcugacaaucggcaucagcgggccugauaacggagcuguggccguccugaaguauaauggcauuaucaccgacacaauuaaguccuggagaaacaauauccuccggacccaagagagcgagugugcgugcgugaacgggucuuguuucacggugaugacagauggaccguccgacggccaggccagcuacaaaauuuuucgcaucgaaaagggcaaaaucgucaagucuguugagaugaaugcucccaacuaucauuacgaagagugcagcuguuacccugauuccucugagauuaccugcgugugcagagacaauuggcacgggagcaaccggcccuggguguccuucaaucagaaccuggaauaucagaucggauacauuuguagcggcaucuuuggggauaauccucgccccaacgacaaaacaggaucuugcggcccggucuccagcaauggggccaacggagugaagggcuucucuuuuaaguauggcaacgggguuuggauuggaagaaccaaauccaucagcucccggaauggcuucgagaugauuugggauccuaacggguggacccgcacagacaauaacuuuucuaucaagcaagacaucgugggaauuaaugaauggagcggcuacuccgggucuuucguccagcaucccgagcuuacgggccuggauuguaucagaccuugcuucuggguggaacucauucggggacgccccaaagagaacaccaucuggacaagcggcuccagcauuucuuuuugugggguuaauuccgacaccgugggauggagcuggcccgauggcgcugagcugccuuucacaaucgacaaguga

SEQ ID NO: 201427 - RNA, 1410 nt, Artificial Sequence
  derived and/or modified sequence opt5 from neuraminidase__InfluenzaA__ADD98171
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagacaguggucagcgugaaacuugcgggaaauuccucucugugcccuguuagcggcugggcuaucuacuccaaggacaacagcaucagaauugggucuaaaggagauguguuugucauccgggagccguucauuuccuguagcccccucgaaugccgcaccuuuuuccugacacagggcgcccuucugaaugacaagcauucuaacggcaccaucaaagauagauccccuuaucggacgcucaugagcugucccauuggggaggugccuucucccuacaacucccgcuuugaaagcguugccugguccgcuucugccugccacgacggaaucaauuggcugaccaucggcauuagcgggccugauaacggagcuguggccguccugaaguauaauggcaucauuacagacaccaucaaguccuggagaaacaauauucuccggacacaagagagcgagugugcgugcgugaacgggucuuguuucaccgugaugacggauggaccguccgacggccaggccagcuacaaaaucuuucgcaucgaaaagggcaaaauugucaagucuguugagaugaaugcucccaacuaucauuacgaagagugcagcuguuacccugauuccucugagaucacaugcgugugcagagacaauuggcacgggagcaaccggcccuggguguccuucaaucagaaccuggaauaucagauuggauacaucuguagcggcauuuuuggggauaauccucgcucuaacgacaaaaccggauccugcggccccgucagcucuaauggggccaacggagugaagggcuucuccuuuaaguauggcaacgggguuuggaucggaagaacaaaaagcauuuccucucggaauggcuucgagaugaucugggauccgaacggguggaccggaaccgacaauaacuuuagcaucaagcaagacauugugggcaucaaugaaugguccggguacucuggcagcuucguccagcauccugagcuuacaggacuggauuguauucgccccugcuucuggguggaacucaucagaggccggccuaaagagaacacgauuuggaccuccgggagcucuaucuccuuuuguggaguuaauagcgacacagugggcuggucuuggcccgauggggcugagcugcccuucaccaucgacaaguga

SEQ ID NO: 201428 - RNA, 1410 nt, Artificial Sequence
  derived and/or modified sequence opt5 from neuraminidase__InfluenzaA__ADD98181
augaaccccaaucagaagaucauuaccaucggcagcgugugcaugacaauugggauggccaaccugauccuccaaauuggaaauaugaucuccaucuggauuucucacagcauccagcuggagaaccagaaucagauugaaacguguaaccaauccgucaucaccuacgagaauaacacauggguuaaucagaccuaugugaacauuucuaauacaaacuucgcugccggccagagcguggucuccgugaaacuugcgggaaauucuagccugugcccuguuuccgggugggcuaucuacagcaaggacaacucuauuagaaucggcuccaaaggggauguguuugucauccgggaaccguucauuagcuguucuccccucgagugccgcaccuuuuuccugacacagggagcccuucugaaugacaagcauuccaacggcaccaucaaagauagaagcccuuaucggacgcucaugucuugucccauuggcgaagugccuucccccuacaacagccgcuuugaguccguugccuggucugcuagcgccugccacgacgggaucaauuggcugaccauuggaaucuccggcccugauaacggggcuguggccguccugaaguauaauggaaucauuacagacaccaucaagagcuggagaaacaauauucuccggacacaagagucugaaugugcgugcgugaacggcuccuguuucaccgugaugacggaugggccgagcgacggacaggccucuuacaaaaucuuucgcauugagaagggcaaaaucgucaagagcguugaaaugaaugcucccaacuaucauuacgaggagugcuccuguuacccugauucuagcgaaaucacaugcgugugcagagacaauuggcacggcuccaaccggcccugggugagcuucaaucagaaccuggaguaucagauuggguacaucuguucuggaauuuuuggcgauaauccucgccccaacgacaaaaccggguccugcggaccggucagcucuaauggcgccaacggggugaagggauucuccuuuaaguauggcaacggcguuuggaucgggagaacaaaaagcauuuccucucggaauggauucgaaaugaucugggauccuaacggcuggaccgggaccgacaauaacuuuagcauuaagcaagacaucgugggaaucaaugagugguccggcuacucugggagcuucguccagcaucccgaacuuacaggccuggauuguauucgcccuugcuucuggguggagcucaucagaggacggcccaaagagaacacgauuuggaccuccggcagcucuaucuccuuuugugggguuaauagcgacacagugggauggucuuggcccgauggcgcugaacugccuuucaccauugacaaguga

SEQ ID NO: 201429 - RNA, 1410 nt, Artificial Sequence; identical to SEQ ID NO: 199762
  derived and/or modified sequence opt5 from neuraminidase__InfluenzaA__ADD98201

SEQ ID NO: 201430 - RNA, 1410 nt, Artificial Sequence; identical to SEQ ID NO: 199762
  derived and/or modified sequence opt5 from neuraminidase__InfluenzaA__ADD98211

SEQ ID NO: 201431 - RNA, 1410 nt, Artificial Sequence; identical to SEQ ID NO: 200985
  derived and/or modified sequence opt5 from neuraminidase__InfluenzaA__ADE20324

SEQ ID NO: 201432 - RNA, 1410 nt, Artificial Sequence; identical to SEQ ID NO: 200985
  derived and/or modified sequence opt5 from neuraminidase__InfluenzaA__ADE20334

SEQ ID NO: 201433 - RNA, 1410 nt, Artificial Sequence; identical to SEQ ID NO: 200985
  derived and/or modified sequence opt5 from neuraminidase__InfluenzaA__ADE20344

SEQ ID NO: 201434 - RNA, 1410 nt, Artificial Sequence; identical to SEQ ID NO: 200985
  derived and/or modified sequence opt5 from neuraminidase__InfluenzaA__ADE20354

SEQ ID NO: 201435 - RNA, 1410 nt, Artificial Sequence; identical to SEQ ID NO: 200985
  derived and/or modified sequence opt5 from neuraminidase__InfluenzaA__ADE20378

SEQ ID NO: 201436 - RNA, 1410 nt, Artificial Sequence; identical to SEQ ID NO: 200985
  derived and/or modified sequence opt5 from neuraminidase__InfluenzaA__ADE20391

SEQ ID NO: 201437 - RNA, 1410 nt, Artificial Sequence; identical to SEQ ID NO: 200985
  derived and/or modified sequence opt5 from neuraminidase__InfluenzaA__ADE20631

SEQ ID NO: 201438 - RNA, 1410 nt, Artificial Sequence; identical to SEQ ID NO: 200985
  derived and/or modified sequence opt5 from neuraminidase__InfluenzaA__ADE20641

SEQ ID NO: 201439 - RNA, 1410 nt, Artificial Sequence
  derived and/or modified sequence opt5 from neuraminidase__InfluenzaA__ADE20651
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucugucagaaucggguccaaaggagauguguuuguuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccgucgcuuggucugccagcgcuugccacgacggaaucaauuggcugaccauuggcaucuccgggccugauaacggagccguggcugugcugaaguauaauggcaucauuacagacaccaucaagagcuggagaaacaauauucuccggacacaagagucugagugugccugcgucaacggguccuguuucaccguuaugacggauggaccgagcgacggccaggcgucuuacaaaaucuuucgcauugaaaagggcaaaaucgucaagagcguggagaugaaugcccccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccgguuagcucuaauggggcuaacggagugaagggcuucuccuuuaaguauggcaacggggucuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguucagcaucccgagcuuacaggacuggauuguauucgcccuugcuucuggguggaacucaucagaggccggcccaaagagaacacgauuuggaccuccgggagcucuaucuccuuuuguggagucaauagcgacacagugggcuggucuuggcccgauggggccgagcugccuuucaccauugacaaguga

SEQ ID NO: 201440 - RNA, 1410 nt, Artificial Sequence; identical to SEQ ID NO: 200985
  derived and/or modified sequence opt5 from neuraminidase__InfluenzaA__ADE20661

SEQ ID NO: 201441 - RNA, 1410 nt, Artificial Sequence; identical to SEQ ID NO: 200985
  derived and/or modified sequence opt5 from neuraminidase__InfluenzaA__ADE20671

SEQ ID NO: 201442 - RNA, 1410 nt, Artificial Sequence; identical to SEQ ID NO: 200985
  derived and/or modified sequence opt5 from neuraminidase__InfluenzaA__ADE20681

SEQ ID NO: 201443 - RNA, 1410 nt, Artificial Sequence
  derived and/or modified sequence opt5 from neuraminidase__InfluenzaA__ADE20701
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcgugaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucguucagcaucccgagcuuacaggacuggacuguauccgcccuugcuucuggguggaacucauuagaggccggcccaaagagaauacgaucuggaccuccgggagcucuauuuccuuuuguggagucaacagcgauacagugggcuggucuuggcccgacggggcugagcugccuuucaccaucgauaaguga

SEQ ID NO: 201444 - RNA, 1410 nt, Artificial Sequence; identical to SEQ ID NO: 200985
  derived and/or modified sequence opt5 from neuraminidase__InfluenzaA__ADE20711

SEQ ID NO: 201445 - RNA, 1410 nt, Artificial Sequence
  derived and/or modified sequence opt5 from neuraminidase__InfluenzaA__ADE20721
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucugucagaaucggguccaaaggagauguguuuguuauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccgucgcuuggucugccagcgcuugccacgacggaaucaauuggcugaccauuggcaucuccgggccugauaacggagccguggcugugcugaaguauaauggcaucauuacagacaccaucaagagcuggagaaacaauauucuccggacacaagagucugagugugccugcgucaacggguccuguuucaccguuaugacggauggaccgagcaauggccaggcgucuuacaaaaucuuucgcauugaaaagggcaaaaucgucaagagcguggagaugaacgcccccaauuaucauuacgaagagugcuccuguuacccugacucuagcgagaucacaugcgugugcagagauaacuggcacggguccaaucggcccugggugagcuucaaccagaaucuggaauaucagauuggauacaucuguucuggcauuuuuggggacaacccucgccccaaugauaaaaccggauccugcggcccgguuagcucuaacggggcuaacggagugaagggcuucuccuuuaaguauggcaauggggucuggaucggaagaacaaaaagcauuuccucucggaacggcuucgagaugaucugggacccuaauggguggaccggaaccgauaacaauuuuagcauuaagcaagacaucgugggcaucaacgaaugguccggguacucuggcagcuucguucagcaucccgagcuuacaggacuggacuguauucgcccuugcuucuggguggaacucaucagaggccggcccaaagagaauacgauuuggaccuccgggagcucuaucuccuuuuguggagucaacagcgauacagugggcuggucuuggcccgacggggccgagcugccuuucaccauugaucgcuga

SEQ ID NO: 201446 - RNA, 1410 nt, Artificial Sequence; identical to SEQ ID NO: 201443
  derived and/or modified sequence opt5 from neuraminidase__InfluenzaA__ADE20731

SEQ ID NO: 201447 - RNA, 1410 nt, Artificial Sequence; identical to SEQ ID NO: 200985
  derived and/or modified sequence opt5 from neuraminidase__InfluenzaA__ADE20741

SEQ ID NO: 201448 - RNA, 1410 nt, Artificial Sequence; identical to SEQ ID NO: 200985
  derived and/or modified sequence opt5 from neuraminidase__InfluenzaA__ADE20751

SEQ ID NO: 201449 - RNA, 1410 nt, Artificial Sequence; identical to SEQ ID NO: 201443
  derived and/or modified sequence opt5 from neuraminidase__InfluenzaA__ADE20761

SEQ ID NO: 201450 - RNA, 1410 nt, Artificial Sequence; identical to SEQ ID NO: 201443
  derived and/or modified sequence opt5 from neuraminidase__InfluenzaA__ADE20781

SEQ ID NO: 201451 - RNA, 1410 nt, Artificial Sequence; identical to SEQ ID NO: 199762
  derived and/or modified sequence opt5 from neuraminidase__InfluenzaA__ADE20791

SEQ ID NO: 201452 - RNA, 1410 nt, Artificial Sequence; identical to SEQ ID NO: 199762
  derived and/or modified sequence opt5 from neuraminidase__InfluenzaA__ADE20801

SEQ ID NO: 201453 - RNA, 1410 nt, Artificial Sequence; identical to SEQ ID NO: 199762
  derived and/or modified sequence opt5 from neuraminidase__InfluenzaA__ADE20811

SEQ ID NO: 201454 - RNA, 1410 nt, Artificial Sequence; identical to SEQ ID NO: 199762
  derived and/or modified sequence opt5 from neuraminidase__InfluenzaA__ADE20821

SEQ ID NO: 201455 - RNA, 1410 nt, Artificial Sequence; identical to SEQ ID NO: 199762
  derived and/or modified sequence opt5 from neuraminidase__InfluenzaA__ADE20831

SEQ ID NO: 201456 - RNA, 1410 nt, Artificial Sequence; identical to SEQ ID NO: 199762
  derived and/or modified sequence opt5 from neuraminidase__InfluenzaA__ADE20841

SEQ ID NO: 201457 - RNA, 1410 nt, Artificial Sequence; identical to SEQ ID NO: 199762
  derived and/or modified sequence opt5 from neuraminidase__InfluenzaA__ADE20851

SEQ ID NO: 201458 - RNA, 1410 nt, Artificial Sequence; identical to SEQ ID NO: 201378
  derived and/or modified sequence opt5 from neuraminidase__InfluenzaA__ADE20861

SEQ ID NO: 201459 - RNA, 1410 nt, Artificial Sequence; identical to SEQ ID NO: 199762
  derived and/or modified sequence opt5 from neuraminidase__InfluenzaA__ADE20871

SEQ ID NO: 201460 - RNA, 1410 nt, Artificial Sequence; identical to SEQ ID NO: 201374
  derived and/or modified sequence opt5 from neuraminidase__InfluenzaA__ADE20881

SEQ ID NO: 201461 - RNA, 1410 nt, Artificial Sequence; identical to SEQ ID NO: 199762
  derived and/or modified sequence opt5 from neuraminidase__InfluenzaA__ADE20891

SEQ ID NO: 201462 - RNA, 1410 nt, Artificial Sequence; identical to SEQ ID NO: 199762
  derived and/or modified sequence opt5 from neuraminidase__InfluenzaA__ADE20901

SEQ ID NO: 201463 - RNA, 1410 nt, Artificial Sequence; identical to SEQ ID NO: 199762
  derived and/or modified sequence opt5 from neuraminidase__InfluenzaA__ADE20911

SEQ ID NO: 201464 - RNA, 1410 nt, Artificial Sequence; identical to SEQ ID NO: 199762
  derived and/or modified sequence opt5 from neuraminidase__InfluenzaA__ADE20921

SEQ ID NO: 201465 - RNA, 1410 nt, Artificial Sequence
  derived and/or modified sequence opt5 from neuraminidase__InfluenzaA__ADE20931
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccgguccuuagcaauggggccaacggagugaagggcuucucuuuuaaguauggcaacgggguuuggauuggaagaacaaaauccaucggcagccggaauggguucgagaugauuugggauccuaacggauggaccggcaccgacaauaacuuuuccaucaagcaagacaucguggggauuaaugaauggucuggcuacagcggauccuucguccagcaucccgagcugacaggccucgauuguauccgcccuugcuucuggguggaacugauuagagggcggcccaaagagaacacgaucuggaccucuggaagcuccauuagcuuuuguggcguuaauucugacacaguggggugguccuggcccgauggagcugagcuuccuuucaccaucgacaaguga

SEQ ID NO: 201466 - RNA, 1410 nt, Artificial Sequence; identical to SEQ ID NO: 199762
  derived and/or modified sequence opt5 from neuraminidase__InfluenzaA__ADE20941

SEQ ID NO: 201467 - RNA, 1410 nt, Artificial Sequence
  derived and/or modified sequence opt5 from neuraminidase__InfluenzaA__ADE20951
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacguggucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 201468 - RNA, 1410 nt, Artificial Sequence
  derived and/or modified sequence opt5 from neuraminidase__InfluenzaA__ADE20961
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaaugacauuaucacagauaccauuaagagcuggagaaacaauauccuccggacacaagagucugagugugcgugcgugaacggcuccuguuucaccgugaugacggacgggccgagcgauggacaggccucuuacaaaauuuuucgcaucgaaaagggcaaaaucgucaagagcguugagaugaaugcucccaacuaucauuacgaagagugcuccuguuacccugacucuagcgagauuacaugcgugugcagagauaauuggcacggcuccaaccggcccugggugagcuucaaucagaaccuggaauaucagaucggguacauuuguucuggaaucuuuggcgacaauccucgccccaacgauaaaaccggguccugcggaccggucagcucuaauggcgccaacggggugaagggauucuccuuuaaguauggcaacggcguuuggauugggagaacaaaaagcaucuccucucggaauggauucgagaugauuugggacccuaacggcuggaccgggaccgacaauaacuuuagcaucaagcaagauaucgugggaauuaaugaaugguccggcuacucugggagcuucguccagcaucccgagcuuacaggccuggacuguauccgcccuugcuucuggguggaacucauuagaggacggcccaaagagaacacgaucuggaccuccggcagcucuauuuccuuuugugggguuaauagcgauacagugggauggucuuggcccgacggcgcugagcugccuuucaccaucgauaaguga

SEQ ID NO: 201469 - RNA, 1410 nt, Artificial Sequence; identical to SEQ ID NO: 199762
  derived and/or modified sequence opt5 from neuraminidase__InfluenzaA__ADE20971

SEQ ID NO: 201470 - RNA, 1410 nt, Artificial Sequence; identical to SEQ ID NO: 201378
  derived and/or modified sequence opt5 from neuraminidase__InfluenzaA__ADE20981

SEQ ID NO: 201471 - RNA, 1410 nt, Artificial Sequence; identical to SEQ ID NO: 199762
  derived and/or modified sequence opt5 from neuraminidase__InfluenzaA__ADE20991

SEQ ID NO: 201472 - RNA, 1410 nt, Artificial Sequence
  derived and/or modified sequence opt5 from neuraminidase__InfluenzaA__ADE21001
augaaccccaaucagaagaucauuaccaucggcagcgugugcaugacaauugggauggccaaccugauccuccaaauuggaaauaucaucuccauuuggaucucucacacgauucagcugggcaaccagaaucagaucgagaccuguaaccaaagcgucauuacauacgaaaauaacaccuggguuaaucagacauaugugaacaucuccaauaccaacuucgcugccgggcagucuguggucagcgugaaacuugcgggaaauuccucucugugcccuguuagcggcugggcuauuuacuccaaggacaacagcaucagaaucgggucuaaaggagauguguuuauuauccgggagccguucauuuccuguagcccccucgaaugccgcacauuuuuccugacccagggcgcccuucugaaugacaagcauucuaacggcacgaucaaagauagauccccuuaucggacccucaugagcugucccauuggggaggucccuucucccuacaacucccgcuuugaaagcguggccugguccgcuucugccugccacgacggaaucaauuggcugacaaucggcauuagcgggccugauaacggagcuguugccgugcugaaguauaauggcaucauuaccgacacaaucaaguccuggagaaacaauauucuccggacccaagagagcgagugugcgugcgucaacgggucuuguuucacggugaugacagauggaccguccgacggccaggccagcuacaaaaucuuucgcaucgaaaagggcaaaauugugaagucugucgagaugaaugcucccaacuaucauuacgaagagugcagcuguuacccugauuccucugagauuaccugcguuugcagagacaauuggcacgggagcaaccggcccuggguguccuucaaucagaaccuggaauaucagaucggauacaucuguagcggcauuuuuggggauaauccucgccccaacgacaaaacaggaucuugcggcccgguguccagcaauggggccaacggagucaagggcuucucuuuuaaguauggcaacgggguguggaucggaagaaccaaauccauuagcucccggaauggcuucgagaugaucugggauccuaacggguggaccggaacagacaauaacuuuucuaucaagcaagacauuguuggcaucaaugaauggagcggguacuccggcucuuucgugcagcaucccgagcuuacgggacuggauuguauucgcccuugcuucugggucgaacucaucagaggccggcccaaagagaacaccauuuggacaagcggguccagcaucucuuuuuguggaguuaauuccgacaccgugggcuggagcuggcccgauggggcugagcugccuuucacaaucgacaaguga

SEQ ID NO: 201473 - RNA, 1410 nt, Artificial Sequence; identical to SEQ ID NO: 199762
  derived and/or modified sequence opt5 from neuraminidase__InfluenzaA__ADE21011

SEQ ID NO: 201474 - RNA, 1410 nt, Artificial Sequence; identical to SEQ ID NO: 199762
  derived and/or modified sequence opt5 from neuraminidase__InfluenzaA__ADE21021

SEQ ID NO: 201475 - RNA, 1410 nt, Artificial Sequence; identical to SEQ ID NO: 201411
  derived and/or modified sequence opt5 from neuraminidase__InfluenzaA__ADE21031

SEQ ID NO: 201476 - RNA, 1410 nt, Artificial Sequence
  derived and/or modified sequence opt5 from neuraminidase__InfluenzaA__ADE21041
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcauugagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201477 - RNA, 1410 nt, Artificial Sequence; identical to SEQ ID NO: 199762
  derived and/or modified sequence opt5 from neuraminidase__InfluenzaA__ADE21051

SEQ ID NO: 201478 - RNA, 1410 nt, Artificial Sequence
  derived and/or modified sequence opt5 from neuraminidase__InfluenzaA__ADE21071
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuaacggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaaguuuucuaucaaacaagacaucgugggcauuaaugaauggagcggguacuccggcucuuucguccagcaucccgagcuuacaggacuggauuguauccgcccuugcuucuggguggaacucauuagaggccggcccaaggagaacacgaucuggaccagcggguccagcauuucuuuuuguggaguuaauuccgacacagugggcuggagcuggcccgauggggcugagcugccuuucaccaucgacaaauga

SEQ ID NO: 201479 - RNA, 1413 nt, Artificial Sequence; identical to SEQ ID NO: 199656
  derived and/or modified sequence opt5 from neuraminidase__InfluenzaA__ADE28752

SEQ ID NO: 201480 - RNA, 1413 nt, Artificial Sequence; identical to SEQ ID NO: 200485
  derived and/or modified sequence opt5 from neuraminidase__InfluenzaA__ADE28763

SEQ ID NO: 201481 - RNA, 1410 nt, Artificial Sequence; identical to SEQ ID NO: 200985
  derived and/or modified sequence opt5 from neuraminidase__InfluenzaA__ADE28773

SEQ ID NO: 201482 - RNA, 1410 nt, Artificial Sequence; identical to SEQ ID NO: 200985
  derived and/or modified sequence opt5 from neuraminidase__InfluenzaA__ADE28783

SEQ ID NO: 201483 - RNA, 1410 nt, Artificial Sequence; identical to SEQ ID NO: 201443
  derived and/or modified sequence opt5 from neuraminidase__InfluenzaA__ADE28803

SEQ ID NO: 201484 - RNA, 1410 nt, Artificial Sequence; identical to SEQ ID NO: 199762
  derived and/or modified sequence opt5 from neuraminidase__InfluenzaA__ADE28813

SEQ ID NO: 201485 - RNA, 1410 nt, Artificial Sequence; identical to SEQ ID NO: 199762
  derived and/or modified sequence opt5 from neuraminidase__InfluenzaA__ADE28823

SEQ ID NO: 201486 - RNA, 1410 nt, Artificial Sequence
  derived and/or modified sequence opt5 from neuraminidase__InfluenzaA__ADE28843
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccguuggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucguucagcaucccgagcuuacaggacuggacuguauccgcccuugcuucuggguggaacucauuagaggccggcccaaagagaauacgaucuggaccuccgggagcucuauuuccuuuuguggagucaacagcgauacagugggcuggucuuggcccgacggggcugagcugccuuucaccaucgauaaguga

SEQ ID NO: 201487 - RNA, 1410 nt, Artificial Sequence
  derived and/or modified sequence opt5 from neuraminidase__InfluenzaA__ADE28853
augaaccccaaucagaagaucauuaccaucgugagcgucugcaugacaauuggcauggccaaccugauccuccaaauugggaauaucaucuccauuuggaucucucacagcauucagcugggaaaccagaaucagaucgagacguguaaccaauccguuauuaccuacgaaaauaacacaugggugaaucagaccuaugugaacaucucuaauacaaacuucgcugccggccagagcgucguguccguuaaacuugcggggaauagcagccugugcccuguguccggaugggcuauuuacagcaaggacaacucugucagaaucggcuccaaaggggauguguuuguuauccgggagccguucauuagcuguucuccccucgaaugccgcaccuuuuuccugacacagggagcccuucugaaugacaagcauuccaacggcaccaucaaagauagaagcccuuaucggacgcucaugucuugucccauuggcgaggugccuucccccuacaacagccgcuuugaauccgucgccuggucugcuagcgccugccacgacgggaucaauuggcugaccauuggaaucuccggcccugauaacggggcuguggccgugcugaaguauaauggaaucauuacagacaccaucaagagcuggagaaacaauauucuccggacacaagagucugagugugcgugcgucaacggcuccuguuucaccguuaugacggaugggccgagcaauggacaggccucuuacaaaaucuuucgcauugaaaagggcaaaaucgugaagucuguggagaugaacgcucccaauuaucauuacgaagagugcuccuguuacccugacucuagcgagaucacaugcgucugcagagauaacuggcacggcuccaaucggcccugggugagcuucaaccagaaucuggaauaucagauuggguacaucuguucuggaauuuuuggcgacaacccucgccccaaugauaaaaccggguccugcggaccgguuagcucuaacggcgccaacggggugaagggauucuccuuuaaguauggcaauggcgucuggaucgggagaacaaaaagcauuuccucucggaacggauucgagaugaucugggacccuaauggcuggaccgggaccgauaacaauuuuagcauuaagcaagacaucgugggaaucaacgaaugguccggcuacucugggagcuucguucagcaucccgagcuuacaggccuggacuguauucgcccuugcuucuggguggaacucaucagaggacggcccaaagagaauacgauuuggaccuccggcagcucuaucuccuuuuguggggucaacagcgauacagugggauggucuuggcccgacggcgcugagcugccuuucaccauugauaaguga

SEQ ID NO: 201488 - RNA, 1410 nt, Artificial Sequence; identical to SEQ ID NO: 201486
  derived and/or modified sequence opt5 from neuraminidase__InfluenzaA__ADE28884

SEQ ID NO: 201489 - RNA, 1410 nt, Artificial Sequence
  derived and/or modified sequence opt5 from neuraminidase__InfluenzaA__ADE28894
augaaccccaaucagaagaucauuaccaucggcagcgugugcaugacaauugggauggccaaccugauccuccaaauuggaaauaucaucuccauuuggaucucucacagcguccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucugucagaauuggguccaaaggagauguguuuguuauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccgucgccuggucugcuagcgccugccacgacggaauuaauuggcugaccaucggcauuuccgggccugauaacggagcuguggccgugcugaaguauaauggcaucaucacagacaccauuaagagcuggagaaacaauauccuccggacacaagagucugagugugcgugcgucaacggguccuguuucaccguuaugacggauggaccgagcaauggccaggccucuuacaaaauuuuucgcaucgaaaagggcaaaauugucaagagcguggagaugaacgcucccaauuaucauuacgaagagugcuccuguuacccugacucuagcgagaucacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccgguuagcucuaacggggccaacggagugaagggcuucuccuuuaaguauggcaauggggucuggauuggaagaacaaaaagcaucuccucucggaacggcuucgagaugauuugggacccuaauggguggaccggaaccgauaacaauuuuagcaucaagcaagacauugugggcaucaacgaaugguccggguacucuggcagcuucguucagcaucccgagcuuacaggacuggacuguauccgcccuugcuucuggguggaacucauuagaggccggcccaaagagaauacgaucuggaccuccgggagcucuauuuccuuuuguggagucaacagcgauacagugggcuggucuuggcccgacggggcugagcugccuuucaccaucgauaaguga

SEQ ID NO: 201490 - RNA, 1410 nt, Artificial Sequence; identical to SEQ ID NO: 201410
  derived and/or modified sequence opt5 from neuraminidase__InfluenzaA__ADE28904

SEQ ID NO: 201491 - RNA, 1410 nt, Artificial Sequence; identical to SEQ ID NO: 199762
  derived and/or modified sequence opt5 from neuraminidase__InfluenzaA__ADE28914

SEQ ID NO: 201492 - RNA, 1410 nt, Artificial Sequence; identical to SEQ ID NO: 199762
  derived and/or modified sequence opt5 from neuraminidase__InfluenzaA__ADE28924

SEQ ID NO: 201493 - RNA, 1410 nt, Artificial Sequence
  derived and/or modified sequence opt5 from neuraminidase__InfluenzaA__ADE28934
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcauuaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201494 - RNA, 1410 nt, Artificial Sequence; identical to SEQ ID NO: 199762
  derived and/or modified sequence opt5 from neuraminidase__InfluenzaA__ADE28954

SEQ ID NO: 201495 - RNA, 1410 nt, Artificial Sequence
  derived and/or modified sequence opt5 from neuraminidase__InfluenzaA__ADE28964
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauauuaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201496 - RNA, 1410 nt, Artificial Sequence; identical to SEQ ID NO: 199762
  derived and/or modified sequence opt5 from neuraminidase__InfluenzaA__ADE28974

SEQ ID NO: 201497 - RNA, 1410 nt, Artificial Sequence
  derived and/or modified sequence opt5 from neuraminidase__InfluenzaA__ADE29004
augaaccccaaucagaagaucauuaccaucggcagcgugugcaugacaauugggcuggccaaccucauccugcaaauuggaaauaucaucuccauuuggaucucucacagcauucagcuuggcaaccagaaucagaucgagacguguaaccaauccgucauuaccuacgaaaauaacacauggguuaaucagaccuaugugaacaucucuaauacaaacuucgcugccgggcagagcguggucuccgugaaacuggcgggaaauucuagccucugcccuguuuccggcugggcuauuuacagcaaggacaacucugugagaaucggguccaaaggagaugucuuugugauccgggagccguucauuagcuguucuccccuggaaugccgcaccuuuuuccuuacacagggcgcccugcucaaugacaagcauuccaacggcaccaucaaagauagaagcccuuaucggacgcugaugucuugucccauuggggagguuccuucccccuacaacagccgcuuugaauccguggccuggucugcuagcgccugccacgacggaaucaauuggcugaccauuggcaucuccgggccugauaacggagcugucgccgugcucaaguauaauggcaucauuacagacaccaucaagagcuggagaaacaauauucugcggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuugaauaucgcauuggauacaucuguucuggcauuuuuggggauaauccuagacccaacgacaaaaccggauccugcggcccggugagcucuaauggggccaacggaguuaagggcuucuccuuuaaguauggcaacgggguguggaucggacggacaaaaagcauuuccucucgcaauggcuucgagaugaucugggauccuaacggguggaccggaaccgacaagaauuuuagcauuaaacaggacaucgucggcaucaacgaaugguccggguacucuggcagcuucgugcaacaucccgagcugacaggacucgauuguauuagaccuugcuucuggguugaacugauccggggccgccccaaggagaauacgauuuggaccuccgggagcucuaucuccuuuuguggagugaacagcgacacagucggcuggucuuggcccgauggggcugagcuuccuuucaccauugacaaauga

SEQ ID NO: 201498 - RNA, 1410 nt, Artificial Sequence; identical to SEQ ID NO: 199762
  derived and/or modified sequence opt5 from neuraminidase__InfluenzaA__ADE29014

SEQ ID NO: 201499 - RNA, 1410 nt, Artificial Sequence
  derived and/or modified sequence opt5 from neuraminidase__InfluenzaA__ADE29024
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggaaaaacaauauccucagaacacaagagucugagugugcgugcgugaacggguccuguuucaccgugaugacggauggaccgagcgacggccaggccucuuacaagauuuuucggaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaucuccucuagaaauggcuucgagaugauuugggauccuaacggguggaauggaaccgacaacaauuuuagcaucaaacaagacaucgugggcauuaacgaaugguccggguacucuggcagcuucguccagcaucccgagcuuaccggacuggauuguauccggccuugcuucuggguggaacucauucgcggcagacccaaggagaauacaaucuggacguccgggagcucuauuuccuuuuguggaguuaacagcgacaccgugggcuggucuuggcccgauggggcugagcugccuuucacaaucgacaaauga

SEQ ID NO: 201500 - RNA, 1410 nt, Artificial Sequence; identical to SEQ ID NO: 199762
  derived and/or modified sequence opt5 from neuraminidase__InfluenzaA__ADE29034

SEQ ID NO: 201501 - RNA, 1410 nt, Artificial Sequence; identical to SEQ ID NO: 199762
  derived and/or modified sequence opt5 from neuraminidase__InfluenzaA__ADE29044

SEQ ID NO: 201502 - RNA, 1410 nt, Artificial Sequence; identical to SEQ ID NO: 199762
  derived and/or modified sequence opt5 from neuraminidase__InfluenzaA__ADE29054

SEQ ID NO: 201503 - RNA, 1410 nt, Artificial Sequence; identical to SEQ ID NO: 201050
  derived and/or modified sequence opt5 from neuraminidase__InfluenzaA__ADE29064

SEQ ID NO: 201504 - RNA, 1410 nt, Artificial Sequence
  derived and/or modified sequence opt5 from neuraminidase__InfluenzaA__ADE29087
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugcaagaccuuuuuccugacacagggcgcccuucugaaugacaaacauuccaacggcaccaucaaggaucgcagcccuuauagaacgcucaugucuugucccauuggggagguuccuucccccuacaacagccgguuugaauccguggccuggucugcuagcgccugccacgacggaaucaauuggcugaccauuggcaucuccgggccugauaacggagcugucgccgugcugaaguauaauggcaucauuacagacaccaucaaaagcuggcgcaacaauauucucagaacacaagagucugagugugcgugcgugaacggguccuguuucaccgucaugacggauggaccgagcaauggccaggccucuuacaagaucuuucggauugaaaaaggcaagaucguuaaaagcguggagaugaacgcucccaauuaucauuacgaagagugcuccuguuacccugacucuagcgagaucacaugcgugugccgcgauaacuggcacggguccaauagacccugggucagcuucaaccagaaucuggaauaucagauuggauacaucuguucuggcauuuuuggggacaacccucggcccaaugauaagaccggauccugcggcccggugagcucuaacggggccaacggaguuaagggcuucuccuuuaaauauggcaaugggguguggaucggacgcacaaagagcauuuccucuagaaacggcuucgagaugaucugggacccuaauggguggaccggaaccgauaacaauuuuagcauuaaacaagacaucgucggcaucaacgaaugguccggguacucuggcagcuucgugcagcaucccgagcuuacaggacuggacuguauucggccuugcuucuggguugaacucauccgcggcagacccaaggagaauacgauuuggaccuccgggagcucuaucuccuuuuguggagugaacagcgauacagucggcuggucuuggcccgacggggcugagcugccuuucaccauugauaaauga

SEQ ID NO: 201505 - RNA, 1410 nt, Artificial Sequence; identical to SEQ ID NO: 199752
  derived and/or modified sequence opt5 from neuraminidase__InfluenzaA__ADE29097

SEQ ID NO: 201506 - RNA, 1410 nt, Artificial Sequence; identical to SEQ ID NO: 200629
  derived and/or modified sequence opt5 from neuraminidase__InfluenzaA__ADE34194

SEQ ID NO: 201507 - RNA, 1410 nt, Artificial Sequence; identical to SEQ ID NO: 199623
  derived and/or modified sequence opt5 from neuraminidase__InfluenzaA__ADE34205

SEQ ID NO: 201508 - RNA, 1410 nt, Artificial Sequence
  derived and/or modified sequence opt5 from neuraminidase__InfluenzaA__ADE34216
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuagcgaaaagucuagacucggcuaugagacauuuaaagucaucgaggggugguccaauccuaagagcaaacugcagaucaaccgccaggugauugucgaucggggaaauagaucuggcuacuccggcaucuucagcguggaagggaaguccuguauuaaccggugcuuuuauguugagcugaucagaggacgcaaggaagagaccgaagugcucuggaccucuaauagcauugucguguucuguggcacauccgggaccuacggaacaggcucuuggcccgacggggcuaacaucaaucugaugccuauuuga

SEQ ID NO: 201509 - RNA, 1410 nt, Artificial Sequence; identical to SEQ ID NO: 200629
  derived and/or modified sequence opt5 from neuraminidase__InfluenzaA__ADE34227

SEQ ID NO: 201510 - RNA, 1410 nt, Artificial Sequence; identical to SEQ ID NO: 200629
  derived and/or modified sequence opt5 from neuraminidase__InfluenzaA__ADE34238

SEQ ID NO: 201511 - RNA, 1410 nt, Artificial Sequence
  derived and/or modified sequence opt5 from neuraminidase__InfluenzaA__ADE34260
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaaccugaugagcaucuga

SEQ ID NO: 201512 - RNA, 1410 nt, Artificial Sequence; identical to SEQ ID NO: 200629
  derived and/or modified sequence opt5 from neuraminidase__InfluenzaA__ADE34271

SEQ ID NO: 201513 - RNA, 1410 nt, Artificial Sequence; identical to SEQ ID NO: 199762
  derived and/or modified sequence opt5 from neuraminidase__InfluenzaA__ADE45502

SEQ ID NO: 201514 - RNA, 1410 nt, Artificial Sequence; identical to SEQ ID NO: 199762
  derived and/or modified sequence opt5 from neuraminidase__InfluenzaA__ADE45504

SEQ ID NO: 201515 - RNA, 1410 nt, Artificial Sequence; identical to SEQ ID NO: 199762
  derived and/or modified sequence opt5 from neuraminidase__InfluenzaA__ADE45506

SEQ ID NO: 201516 - RNA, 1410 nt, Artificial Sequence; identical to SEQ ID NO: 199762
  derived and/or modified sequence opt5 from neuraminidase__InfluenzaA__ADE45508

SEQ ID NO: 201517 - RNA, 1410 nt, Artificial Sequence; identical to SEQ ID NO: 199762
  derived and/or modified sequence opt5 from neuraminidase__InfluenzaA__ADE45510

SEQ ID NO: 201518 - RNA, 1410 nt, Artificial Sequence; identical to SEQ ID NO: 199762
  derived and/or modified sequence opt5 from neuraminidase__InfluenzaA__ADE45512

SEQ ID NO: 201519 - RNA, 1410 nt, Artificial Sequence
  derived and/or modified sequence opt5 from neuraminidase__InfluenzaA__ADE45514
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuucaauauggcaacgggguguggaucggaagaacaaagagcauuuccucucggaauggcuucgagaugaucugggauccuaacggguggaccggaaccgacaauaacuuuagcaucaaacaggacauuguuggcaucaaugaaugguccggguacucuggcagcuucgugcagcaucccgagcuuacaggacuggauuguauucgcccuugcuucugggucgaacucaucagaggccggcccaaggagaacacgauuuggaccuccgggagcucuaucuccuuuuguggagugaauagcgacacaguuggcuggucuuggcccgauggggcugagcugccuuucaccaucgacaaauga

SEQ ID NO: 201520 - RNA, 1410 nt, Artificial Sequence
  derived and/or modified sequence opt5 from neuraminidase__InfluenzaA__ADE45516
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucucccuucggaauggcuucgagaugauuugggauccuaacggguggaccggaaccgacaauaacuuuucuaucaagcaagacaucgugggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 201521 - RNA, 1410 nt, Artificial Sequence
  derived and/or modified sequence opt5 from neuraminidase__InfluenzaA__ADF10069
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcacccuucugaaugacaagcauuccaacggcacgauuaaagauagaagcccuuaucggacccucaugucuugucccaucggggaggugccuucccccuacaacagccgcuuugaauccguugccuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 201522 - RNA, 1410 nt, Artificial Sequence; identical to SEQ ID NO: 199762
  derived and/or modified sequence opt5 from neuraminidase__InfluenzaA__ADF10079

SEQ ID NO: 201523 - RNA, 1410 nt, Artificial Sequence; identical to SEQ ID NO: 199762
  derived and/or modified sequence opt5 from neuraminidase__InfluenzaA__ADF10089

SEQ ID NO: 201524 - RNA, 1410 nt, Artificial Sequence; identical to SEQ ID NO: 199762
  derived and/or modified sequence opt5 from neuraminidase__InfluenzaA__ADF10099

SEQ ID NO: 201525 - RNA, 1410 nt, Artificial Sequence
  derived and/or modified sequence opt5 from neuraminidase__InfluenzaA__ADF10109
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggaaauugcggcccggucuccagcaacggggccaacggagugaagggcuucucuuuuaaguacggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguauuccggcucuuucguccagcaccccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 201526 - RNA, 1410 nt, Artificial Sequence; identical to SEQ ID NO: 199762
  derived and/or modified sequence opt5 from neuraminidase__InfluenzaA__ADF10129

SEQ ID NO: 201527 - RNA, 1410 nt, Artificial Sequence; identical to SEQ ID NO: 201192
  derived and/or modified sequence opt5 from neuraminidase__InfluenzaA__ADF10146

SEQ ID NO: 201528 - RNA, 1410 nt, Artificial Sequence
  derived and/or modified sequence opt5 from neuraminidase__InfluenzaA__ADF10166
augaaccccaaucagaagaucauuaccaucggcagcgugugcaugauuaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaagggcuucgagaugaucugggauccuaauggguggacaggaaccgacaacaauuuuagcaucaaacaagacauugugggcaucaacgaaugguccggguacucuggcagcuucguccagcaucccgagcuuaccggacuggauuguauucgcccuugcuucuggguggaacucaucagaggccggcccaaggagaauacaauuuggacguccgggagcucuaucuccuuuuguggaguuaacagcgacaccgugggcuggucuuggcccgauggggcugagcugccuuucacaaucgacaaauga

SEQ ID NO: 201529 - RNA, 1410 nt, Artificial Sequence; identical to SEQ ID NO: 201528
  derived and/or modified sequence opt5 from neuraminidase__InfluenzaA__ADF10176

SEQ ID NO: 201530 - RNA, 1410 nt, Artificial Sequence; identical to SEQ ID NO: 201528
  derived and/or modified sequence opt5 from neuraminidase__InfluenzaA__ADF10192

SEQ ID NO: 201531 - RNA, 1410 nt, Artificial Sequence; identical to SEQ ID NO: 199762
  derived and/or modified sequence opt5 from neuraminidase__InfluenzaA__ADF10247

SEQ ID NO: 201532 - RNA, 1410 nt, Artificial Sequence; identical to SEQ ID NO: 201528
  derived and/or modified sequence opt5 from neuraminidase__InfluenzaA__ADF10290

SEQ ID NO: 201533 - RNA, 1410 nt, Artificial Sequence
  derived and/or modified sequence opt5 from neuraminidase__InfluenzaA__ADF10304
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcuggacugccuuucaccaucgacaaguga

SEQ ID NO: 201534 - RNA, 1410 nt, Artificial Sequence; identical to SEQ ID NO: 199762
  derived and/or modified sequence opt5 from neuraminidase__InfluenzaA__ADF10340

SEQ ID NO: 201535 - RNA, 1410 nt, Artificial Sequence; identical to SEQ ID NO: 199762
  derived and/or modified sequence opt5 from neuraminidase__InfluenzaA__ADF10361

SEQ ID NO: 201536 - RNA, 1410 nt, Artificial Sequence; identical to SEQ ID NO: 201528
  derived and/or modified sequence opt5 from neuraminidase__InfluenzaA__ADF10371

SEQ ID NO: 201537 - RNA, 1410 nt, Artificial Sequence; identical to SEQ ID NO: 201528
  derived and/or modified sequence opt5 from neuraminidase__InfluenzaA__ADF10407

SEQ ID NO: 201538 - RNA, 1410 nt, Artificial Sequence; identical to SEQ ID NO: 199762
  derived and/or modified sequence opt5 from neuraminidase__InfluenzaA__ADF10472

SEQ ID NO: 201539 - RNA, 1410 nt, Artificial Sequence; identical to SEQ ID NO: 201528
  derived and/or modified sequence opt5 from neuraminidase__InfluenzaA__ADF10616

SEQ ID NO: 201540 - RNA, 1410 nt, Artificial Sequence; identical to SEQ ID NO: 201528
  derived and/or modified sequence opt5 from neuraminidase__InfluenzaA__ADF10688

SEQ ID NO: 201541 - RNA, 1410 nt, Artificial Sequence; identical to SEQ ID NO: 201528
  derived and/or modified sequence opt5 from neuraminidase__InfluenzaA__ADF10726

SEQ ID NO: 201542 - RNA, 1410 nt, Artificial Sequence; identical to SEQ ID NO: 199762
  derived and/or modified sequence opt5 from neuraminidase__InfluenzaA__ADF10773

SEQ ID NO: 201543 - RNA, 1410 nt, Artificial Sequence
  derived and/or modified sequence opt5 from neuraminidase__InfluenzaA__ADF10837
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggaaaaacaauauccucagaacacaagagucugagugugcgugcgugaacggguccuguuucaccgugaugacggauggaccgagcgacggccaggccucuuacaagauuuuucggaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaucuccucuagaaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguauccggccuugcuucuggguggaacucauucgcggcagacccaaggagaacacgaucuggaccuccgggagcucuauuuccuuuuguggaguuaauagcgacacagugggcuggucuuggcccgauggggcugagcugccuuucaccaucgacaaauga

SEQ ID NO: 201544 - RNA, 1410 nt, Artificial Sequence; identical to SEQ ID NO: 199762
  derived and/or modified sequence opt5 from neuraminidase__InfluenzaA__ADF10889

SEQ ID NO: 201545 - RNA, 1410 nt, Artificial Sequence; identical to SEQ ID NO: 199762
  derived and/or modified sequence opt5 from neuraminidase__InfluenzaA__ADF10947

SEQ ID NO: 201546 - RNA, 1410 nt, Artificial Sequence; identical to SEQ ID NO: 199762
  derived and/or modified sequence opt5 from neuraminidase__InfluenzaA__ADF11010

SEQ ID NO: 201547 - RNA, 1410 nt, Artificial Sequence
  derived and/or modified sequence opt5 from neuraminidase__InfluenzaA__ADF27355
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggaugggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 201548 - RNA, 1410 nt, Artificial Sequence
  derived and/or modified sequence opt5 from neuraminidase__InfluenzaA__ADF27356
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaaaaugucauuaccuacgaaaacaauacauggguuaaccagaccuaugugaauaucuccaacacaaauuucgcugccgggcagucuguggucagcgugaaacuugcgggaaacuccucucugugcccuguuagcggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuauuacuacgaagagugcagcuguuauccugauuccucugagauuacaugcgugugcagagacaacuggcaugggagcaaucggcccuggguguccuucaaccagaaucuggaauaccagaucggauauauuuguagcggcaucuuuggggauaacccucgccccaaugacaaaaccggaucuugcggcccggucuccagcaacggggccaacggagugaagggcuucucuuuuaaguacggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguauuccggcucuuucguccagcaccccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 201549 - RNA, 1410 nt, Artificial Sequence; identical to SEQ ID NO: 200116
  derived and/or modified sequence opt5 from neuraminidase__InfluenzaA__ADF27357

SEQ ID NO: 201550 - RNA, 1410 nt, Artificial Sequence; identical to SEQ ID NO: 200116
  derived and/or modified sequence opt5 from neuraminidase__InfluenzaA__ADF27358

SEQ ID NO: 201551 - RNA, 1410 nt, Artificial Sequence; identical to SEQ ID NO: 200116
  derived and/or modified sequence opt5 from neuraminidase__InfluenzaA__ADF27360

SEQ ID NO: 201552 - RNA, 1410 nt, Artificial Sequence; identical to SEQ ID NO: 199762
  derived and/or modified sequence opt5 from neuraminidase__InfluenzaA__ADF27361

SEQ ID NO: 201553 - RNA, 1410 nt, Artificial Sequence; identical to SEQ ID NO: 199762
  derived and/or modified sequence opt5 from neuraminidase__InfluenzaA__ADF27362

SEQ ID NO: 201554 - RNA, 1410 nt, Artificial Sequence; identical to SEQ ID NO: 199762
  derived and/or modified sequence opt5 from neuraminidase__InfluenzaA__ADF27363

SEQ ID NO: 201555 - RNA, 1410 nt, Artificial Sequence; identical to SEQ ID NO: 200116
  derived and/or modified sequence opt5 from neuraminidase__InfluenzaA__ADF27364

SEQ ID NO: 201556 - RNA, 1410 nt, Artificial Sequence; identical to SEQ ID NO: 199762
  derived and/or modified sequence opt5 from neuraminidase__InfluenzaA__ADF27365

SEQ ID NO: 201557 - RNA, 1410 nt, Artificial Sequence; identical to SEQ ID NO: 200116
  derived and/or modified sequence opt5 from neuraminidase__InfluenzaA__ADF27366

SEQ ID NO: 201558 - RNA, 1410 nt, Artificial Sequence; identical to SEQ ID NO: 199762
  derived and/or modified sequence opt5 from neuraminidase__InfluenzaA__ADF27382

SEQ ID NO: 201559 - RNA, 1410 nt, Artificial Sequence; identical to SEQ ID NO: 199762
  derived and/or modified sequence opt5 from neuraminidase__InfluenzaA__ADF27392

SEQ ID NO: 201560 - RNA, 1410 nt, Artificial Sequence; identical to SEQ ID NO: 199762
  derived and/or modified sequence opt5 from neuraminidase__InfluenzaA__ADF27402

SEQ ID NO: 201561 - RNA, 1410 nt, Artificial Sequence; identical to SEQ ID NO: 201543
  derived and/or modified sequence opt5 from neuraminidase__InfluenzaA__ADF27422

SEQ ID NO: 201562 - RNA, 1410 nt, Artificial Sequence
  derived and/or modified sequence opt5 from neuraminidase__InfluenzaA__ADF27432
augaaccccaaucagaagaucauuaccaucggcagcgugugcgucacaauugggauggccaaccugauccuccaaauuggaaauaucaucuccauuuggaucucucacagcauucagcugggcaaccagaaucagaucgagacguguaaccaauccguuauuaccuacgaaaauaacacaugggugaaucagaccuaugugaacaucucuaauacaaacuucgcugccgggcagagcgucguguccguuaaacuugcgggaaauucuagccugugcccuguguccggcugggcuauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggccuggucugcuagcgccugccacgacggaauuaauuggcugaccaucggcaucuccgggccugauaacggagcugucgccgugcugaaguauaauggcauuaucacagacaccauuaagagcuggagaaacaauauccuccggacacaagagucugagugugcgugcgugaacggguccuguuucaccgucaugacggauggaccgagcgacggccaggccucuuacaaaauuuuucgcaucgaaaagggcaaaaucguuaagagcguggagaugaaugcucccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggccaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggcugagcugccuuucaccaucgacaaguga

SEQ ID NO: 201563 - RNA, 1410 nt, Artificial Sequence
  derived and/or modified sequence opt5 from neuraminidase__InfluenzaA__ADF27442
augaaccccaaucagaagaucauuaccaucggcagcgugugcaugacaauugggauggccaaccugauccuccaaauuggaaauaucaucuccauuuggaucucucacagcauucagcuggagaaccagaaucagaucgaaacguguaaccaauccgucauuaccuacgagaauaacacauggguuaaucagaccuaugugaacaucucuaauacaaacuucgcugccggccagagcguggucuccgugaaacuugcgggaaauucuagccugugcccuguuuccgggugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucgugggaauuaaugagugguccggcuacucugggagcuucguccagcaucccgaacuuacaggccuggauuguauccgcccuugcuucuggguggagcucauuagaggacggcccaaagagaacacgaucuggaccuccggcagcucuauuuccuuuugugggguuaauagcgacacagugggauggucuuggcccgauggcgcugaacugccuuucaccaucgacaaguga

SEQ ID NO: 201564 - RNA, 1410 nt, Artificial Sequence
  derived and/or modified sequence opt5 from neuraminidase__InfluenzaA__ADF27462
augaaccccaaucagaagaucauuaccaucggcagcgugugcaugacaauugggauggccaaccugauccuccaaauuggaaauaucaucuccauuuggaucucucacagcauucagcugggcaaccagaaucagaucgaggcuuguaaccaauccgucauuacguacgaaaauaacaccuggguuaaucagacauaugugaacaucucuaauaccaacuucgccgcggggcagagcguggucuccgugaaacuugcuggaaauucuagccugugcccuguuuccggcugggccguguacagcaaggacaacucuauuagaaucggguccaaaggagaugucuuugugauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggagguuccuucccccuacaacagccgcuuugaauccguggcuuggucugccagcgcuugccacgacggaaucaauuggcugacgauuggcaucuccgggccugauaacggagccgucgcggugcugaaguauaauggcaucauuaccgacacaaucaagagcuggagaaacaauauucuccggacccaagagucugagugugccugcgugaacggguccuguuucacagucaugaccgauggaccgagcgacggccaggcuucuuacaaaaucuuucgcauugaaaagggcaaaaucguuaagagcguggagaugaaugcccccaacuaucauuacgaagagugcuccuguuacccugauucuagcgagaucacgugcgugugcagagacaauuggcacggguccaaccggcccugggucagcuucaaucagaaccuggaauaucagauuggauacaucuguucuggcauuuuuggggauaauccucgccccaacgacaaaacaggauccugcggcccggugagcucuaauggggcuaacggaguuaagggcuucuccuuuaaguauggcaacgggguguggaucggaagaaccaaaagcauuuccucucggaauggcuucgagaugaucugggauccuaacggguggacaggaaccgacaauaacuuuagcauuaagcaagacaucgucggcaucaaugaaugguccggguacucuggcagcuucgugcagcaucccgagcuuaccggacuggauuguauucgcccuugcuucuggguugaacucaucagaggccggcccaaagagaacacaauuuggacguccgggagcucuaucuccuuuuguggagugaauagcgacaccgucggcuggucuuggcccgauggggccgagcugccuuucacaauugacaaguga

SEQ ID NO: 201565 - RNA, 1410 nt, Artificial Sequence; identical to SEQ ID NO: 199762
  derived and/or modified sequence opt5 from neuraminidase__InfluenzaA__ADF27472

SEQ ID NO: 201566 - RNA, 1410 nt, Artificial Sequence
  derived and/or modified sequence opt5 from neuraminidase__InfluenzaA__ADF27482
augaaccccaaucagaagaucauuaccaucggcagcgugugcaugacaauugggauggccaaccugauccuccaaauuggaaauaucaucuccauuuggaucucucacagcauucagcugggcaaccagaaucaggucgagacguguaaccaauccaucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 201567 - RNA, 1410 nt, Artificial Sequence
  derived and/or modified sequence opt5 from neuraminidase__InfluenzaA__ADF27492
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagccuuguaaccaauccgucauuacguacgaaaauaacaccuggguuaaucagacauaugugaacaucucuaauaccaacuucgcugccgggcagagcguggucuccgugaaacuugcgggaaauucuagccugugcccgguuuccggcugggcuauuuacagcaaggacaacucuaucagaaucggguccaaaggagauguguuugucauucgggagcccuucaucagcuguucuccucucgaaugccgcacauuuuuccugacccagggcgcccuucugaaugacaagcauuccaacggcacaauuaaagauagaagccccuaucggacccucaugucuuguccuaucggggaggugcccuccccuuacaacagccgcuuugaauccguugccuggucugcuagcgccugccacgacggaauuaauuggcugacgaucggcaucuccgggccggauaacggagcuguggccguccugaaguauaauggcauuaucaccgacacaauuaagagcuggagaaacaauauccuccggacccaagagucugagugugcgugcgugaacggguccuguuucacagugaugaccgauggacccagcgacggccaggccucuuacaaaauuuuucgcaucgaaaagggcaaaaucgucaagagcauugagaugaaugcuccuaacuaucauuacgaagagugcuccuguuaccccgauucuagcgagaucacgugcguuugcagagacaauuggcacggguccaaccggccuugggugagcuucaaucagaaccuggaauaucagauuggauacaucuguucuggcauuuuuggggauaauccccgcccgaacgacaaaacaggauccugcggcccugugagcucuaauggggccaacggagucaagggcuucuccuuuaaguauggcaacgggguguggaucggaagaaccaaaagcauuuccucucggaauggcuucgagaugaucugggaucccaacggguggacaggaaccgacaauaacuuuagcaucaagcaagacauuguuggcaucaaugaaugguccggguacucuggcagcuucgugcagcauccugagcuuaccggacuggauuguauucgccccugcuucugggucgaacucaucagaggccggcccaaagagaacacaguguggacguccgggagcucuauuuccuuuuguggaguuaauagcgacaccgugggcuggucuuggccugauggggcugagcugccguucacaaucgacaaguga

SEQ ID NO: 201568 - RNA, 1410 nt, Artificial Sequence; identical to SEQ ID NO: 199762
  derived and/or modified sequence opt5 from neuraminidase__InfluenzaA__ADF27502

SEQ ID NO: 201569 - RNA, 1410 nt, Artificial Sequence; identical to SEQ ID NO: 199762
  derived and/or modified sequence opt5 from neuraminidase__InfluenzaA__ADF27512

SEQ ID NO: 201570 - RNA, 1410 nt, Artificial Sequence
  derived and/or modified sequence opt5 from neuraminidase__InfluenzaA__ADF27522
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaaucaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201571 - RNA, 1410 nt, Artificial Sequence; identical to SEQ ID NO: 199762
  derived and/or modified sequence opt5 from neuraminidase__InfluenzaA__ADF27532

SEQ ID NO: 201572 - RNA, 1410 nt, Artificial Sequence
  derived and/or modified sequence opt5 from neuraminidase__InfluenzaA__ADF27542
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucgcauuggauacaucuguucuggcauuuuuggggauaauccuagacccaacgacaaaaccggauccugcggcccggugagcucuaauggggccaacggaguuaagggcuucuccuuuaaguauggcaacgggguguggaucggacggacaaaaagcauuuccucucgcaauggcuucgagaugaucugggauccuaacggguggaccggaaccgacaauaacuuuagcauuaagcaggacaucgucggcaucaaugaaugguccggguacucuggcagcuucgugcaacaucccgagcuuacaggacuggauuguauuagaccuugcuucuggguugaacucauccggggccgccccaaagagaacacgauuuggaccuccgggagcucuaucuccuuuuguggagugaauagcgacacagucggcuggucuuggcccgauggggcugagcugccuuucaccauugacaaguga

SEQ ID NO: 201573 - RNA, 1410 nt, Artificial Sequence
  derived and/or modified sequence opt5 from neuraminidase__InfluenzaA__ADF27552
augaaccccaaucagaagaucauuaccaucggcagcgugugcaugacaauugggcuggccaaccucauccugcaaauuggaaauaucaucuccauuugggucucucacagcauccagcuuggcaaccagaaucagauugagacguguaaccaauccguuaucaccuacgaaaauaacacaugggugaaucagaccuaugugaacauuucuaauacaaacuucgcugccgggcagagcgucguguccguuaaacuggcgggaaauucuagccucugcccuguguccggcugggcuaucuacagcaaggacaacucugucagaauuggguccaaaggagauguguuuguuauccgggagccguucaucagcuguucuccccuggaaugccgcaccuuuuuccuuacacagggcgcccugcucaaugacaagcauuccaacggcaccauuaaagauagaagcccuuaucggacgcugaugucuugucccaucggggaggugccuucccccuacaacagccgcuuugaauccgucgccuggucugcuagcgccugccacgacggaauuaauuggcugaccaucggcauuuccgggccugauaacggagcuguggccgugcucaaguauaauggcaucaucacagacaccauuaagagcuggagaaacaauauccugcggacacaagagucugagugugcgugcgucaacggguccuguuucaccguuaugacggauggaccgagcgacggccaggccucuuacaaaauuuuucgcaucgaaaagggcaaaauugucaagagcguggagaugaaugcucccaacuaucauuacgaagagugcuccuguuacccugauucuagcgagaucacaugcgugugcagagacaauuggcacggguccaaccggcccugggugagcuucaaucagaaccuugaauaucgcaucggauacauuuguucuggcaucuuuggggauaauccuagacccaacgacaaaaccggauccugcggcccgguuagcucuaauggggccaacggagugaagggcuucuccuuuaaguauggcaacggggucuggauuggacggacaaaaagcaucuccucucgcaauggcuucgagaugauuugggauccuaacggguggaccggaaccgacaagaauuuuagcaucaaacaggacauugugggcaucaacgaaugguccggguacucuggcagcuucguucaacaucccgagcugacaggacucgauuguaucagaccuugcuucuggguggaacugauucggggccgccccaaggagaauacgaucuggaccuccgggagcucuauuuccuuuuguggagucaacagcgacacagugggcuggucuuggcccgauggggcugagcuuccuuucaccaucgacaaauga

SEQ ID NO: 201574 - RNA, 1410 nt, Artificial Sequence; identical to SEQ ID NO: 200588
  derived and/or modified sequence opt5 from neuraminidase__InfluenzaA__ADF27562

SEQ ID NO: 201575 - RNA, 1410 nt, Artificial Sequence; identical to SEQ ID NO: 199762
  derived and/or modified sequence opt5 from neuraminidase__InfluenzaA__ADF27572

SEQ ID NO: 201576 - RNA, 1410 nt, Artificial Sequence
  derived and/or modified sequence opt5 from neuraminidase__InfluenzaA__ADF27582
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucgcaucggauacauuuguucuggcaucuuuggggauaauccuagacccaacgacaaaaccggauccugcggcccggucagcucuaauggggccaacggagugaagggcuucuccuuuaaguauggcaacgggguuuggauuggacggacaaaaagcaucuccucucgcaauggcuucgagaugauuugggauccuaacggguggaccggaaccgacaauaacuuuagcaucaagcaggacaucgugggcauuaaugaaugguccggguacucuggcagcuucguccaacaucccgagcuuacaggacuggauuguaucagaccuugcuucuggguggaacucauucggggccgccccaaagagaacacgaucuggaccuccgggagcucuauuuccuuuuguggaguuaauagcgacacagugggcuggucuuggcccgauggggcugagcugccuuucaccaucgacaaguga

SEQ ID NO: 201577 - RNA, 1410 nt, Artificial Sequence; identical to SEQ ID NO: 199762
  derived and/or modified sequence opt5 from neuraminidase__InfluenzaA__ADF27592

SEQ ID NO: 201578 - RNA, 1410 nt, Artificial Sequence
  derived and/or modified sequence opt5 from neuraminidase__InfluenzaA__ADF27602
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaagaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauagcuuuuccaucaaacaagacaucgugggcauuaacgaauggucuggguacagcggcuccuucguccagcaucccgagcuuacaggacuggauuguaucagaccuugcuucuggguggaacucauucggggccgccccaaggagaauacgaucuggaccagcgggucuuccauuagcuuuuguggaguuaacucugacacagugggcugguccuggcccgauggggcugagcugccuuucaccaucgacaaauga

SEQ ID NO: 201579 - RNA, 1410 nt, Artificial Sequence; identical to SEQ ID NO: 199762
  derived and/or modified sequence opt5 from neuraminidase__InfluenzaA__ADF27612

SEQ ID NO: 201580 - RNA, 1410 nt, Artificial Sequence; identical to SEQ ID NO: 201050
  derived and/or modified sequence opt5 from neuraminidase__InfluenzaA__ADF27622

SEQ ID NO: 201581 - RNA, 1410 nt, Artificial Sequence; identical to SEQ ID NO: 201497
  derived and/or modified sequence opt5 from neuraminidase__InfluenzaA__ADF27632

SEQ ID NO: 201582 - RNA, 1410 nt, Artificial Sequence; identical to SEQ ID NO: 199762
  derived and/or modified sequence opt5 from neuraminidase__InfluenzaA__ADF27642

SEQ ID NO: 201583 - RNA, 1410 nt, Artificial Sequence; identical to SEQ ID NO: 199762
  derived and/or modified sequence opt5 from neuraminidase__InfluenzaA__ADF27652

SEQ ID NO: 201584 - RNA, 1410 nt, Artificial Sequence
  derived and/or modified sequence opt5 from neuraminidase__InfluenzaA__ADF27662
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugcaaugacggaaucaacuggcugaccauuggcaucuccgggccugauaauggagcugucgccgugcugaaguauaacggcaucauuacagacaccaucaagagcuggagaaauaacauucuccggacacaagagucugagugugcgugcgugaauggguccuguuucaccgucaugacggauggaccgagcgacggccaggccucuuacaaaaucuuucgcauugaaaagggcaaaaucguuaagagcguggagaugaacgcucccaauuaucacuacgaagagugcuccuguuacccugauucuagcgagaucacaugcgugugcagagacaacuggcauggguccaaucggcccugggucagcuucaaccagaaucuggaauaucgcauuggauacaucuguucuggcauuuuuggggauaacccuagacccaaugacaaaaccggauccugcggcccggugagcucuaacggggccaacggaguuaagggcuucuccuuuaaguauggcaaugggguguggaucggacggacaaaaagcauuuccucucgcaacggcuucgagaugaucugggauccuaauggguggaccggaaccgacaacaauuuuagcauuaagcaggacaucgucggcaucaacgaaugguccggguacucuggcagcuucgugcaacaccccgagcuuacaggacuggauuguauuagaccuugcuucuggguugaacucauccggggccgccccaaagagaauacgauuuggaccuccgggagcucuaucuccuuuuguggagugaacagcgacacagucggcuggucuuggcccgauggggcugagcugccuuucaccauugacaaguga

SEQ ID NO: 201585 - RNA, 1410 nt, Artificial Sequence; identical to SEQ ID NO: 199762
  derived and/or modified sequence opt5 from neuraminidase__InfluenzaA__ADF27672

SEQ ID NO: 201586 - RNA, 1410 nt, Artificial Sequence; identical to SEQ ID NO: 199762
  derived and/or modified sequence opt5 from neuraminidase__InfluenzaA__ADF27682

SEQ ID NO: 201587 - RNA, 1410 nt, Artificial Sequence; identical to SEQ ID NO: 199762
  derived and/or modified sequence opt5 from neuraminidase__InfluenzaA__ADF27692

SEQ ID NO: 201588 - RNA, 1410 nt, Artificial Sequence; identical to SEQ ID NO: 199762
  derived and/or modified sequence opt5 from neuraminidase__InfluenzaA__ADF27702

SEQ ID NO: 201589 - RNA, 1410 nt, Artificial Sequence; identical to SEQ ID NO: 199762
  derived and/or modified sequence opt5 from neuraminidase__InfluenzaA__ADF27712

SEQ ID NO: 201590 - RNA, 1410 nt, Artificial Sequence; identical to SEQ ID NO: 201050
  derived and/or modified sequence opt5 from neuraminidase__InfluenzaA__ADF27788

SEQ ID NO: 201591 - RNA, 1410 nt, Artificial Sequence; identical to SEQ ID NO: 201005
  derived and/or modified sequence opt5 from neuraminidase__InfluenzaA__ADF27798

SEQ ID NO: 201592 - RNA, 1410 nt, Artificial Sequence; identical to SEQ ID NO: 201497
  derived and/or modified sequence opt5 from neuraminidase__InfluenzaA__ADF27808

SEQ ID NO: 201593 - RNA, 1410 nt, Artificial Sequence
  derived and/or modified sequence opt5 from neuraminidase__InfluenzaA__ADF27818
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccauuaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuaauucccggaacggcuucgagaugaucugggauccuaauggguggaccggaaccgacaacaauuuuucuaucaagcaagacauuguuggcaucaacgaauggagcggguacuccggcucuuucgugcagcaucccgagcuuacaggacuggauuguauucgcccuugcuucugggucgaacucaucagaggccggcccaaagagaauacgauuuggaccagcggguccagcaucucuuuuuguggagugaacuccgacacaguuggcuggagcuggcccgauggggcugagcugccuuucaccaucgacaaguga

SEQ ID NO: 201594 - RNA, 1410 nt, Artificial Sequence; identical to SEQ ID NO: 199762
  derived and/or modified sequence opt5 from neuraminidase__InfluenzaA__ADF27838

SEQ ID NO: 201595 - RNA, 1410 nt, Artificial Sequence; identical to SEQ ID NO: 199762
  derived and/or modified sequence opt5 from neuraminidase__InfluenzaA__ADF27848

SEQ ID NO: 201596 - RNA, 1410 nt, Artificial Sequence
  derived and/or modified sequence opt5 from neuraminidase__InfluenzaA__ADF27858
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucuagcuccgcuugccacgacggaauuaauuggcugaccaucggcaucagcgggccugauaacggagccguggcuguccugaaguauaauggcauuaucacagacaccauuaagucuuggagaaacaauauccuccggacacaagaguccgagugugccugcgugaacgggagcuguuucaccgugaugacggauggaccgucugacggccaggcgagcuacaaaauuuuucgcaucgaaaagggcaaaaucgucaaguccguugagaugaaugcccccaacuaucauuacgaagagugcucuuguuacccugauagcuccgagauuacaugcgugugcagagacaauuggcacgggagcaaccggcccugggugucuuucaaucagaaccuggaauaucagaucggauacauuuguuccggcaucuuuggggauaauccucgccccaacgacaaaaagggaagcugcggcccggucucuuccaauggggcuaacggagugaagggcuucagcuuuaaauauggcaacgggguuuggauuggaagaaccaaguccaucucuagccggaauggcuucgagaugauuugggauccuaacggguggacaggaaccgacaauaacuuuuccaucaaacaagacaucgugggcauuaaugaauggucuggguacagcggcuccuucguccagcaucccgagcuuaccggacuggauuguauccgcccuugcuucuggguggaacucauuagaggccggcccaaggagaacacaaucuggacgagcgggucuuccauuagcuuuuguggaguuaauggcgacaccgugggguggucuuggcccgauggagccgagcugccuuucacaaucgacaaauga

SEQ ID NO: 201597 - RNA, 1410 nt, Artificial Sequence
  derived and/or modified sequence opt5 from neuraminidase__InfluenzaA__ADF27878
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaagggauccugcggcccggucagcucuaauggggccaacggagugaagggcuucuccuuuaaauauggcaacgggguuuggauuggaagaaccaagagcaucuccucucggaauggcuucgagaugauuugggauccuaacggguggacaggaaccgacaauaacuuuagcaucaaacaagacaucgugggcauuaaugaaugguccggguacucuggcagcuucguccagcaucccgagcuuaccggacuggauuguauccgcccuugcuucuggguggaacucauuagaggccggcccaaggagaacacaaucuggacguccgggagcucuauuuccuuuuguggaguuaauggcgacaccgugggguggagcuggcccgauggagcugagcugccuuucacaaucgacaaauga

SEQ ID NO: 201598 - RNA, 1410 nt, Artificial Sequence; identical to SEQ ID NO: 201050
  derived and/or modified sequence opt5 from neuraminidase__InfluenzaA__ADF27888

SEQ ID NO: 201599 - RNA, 1410 nt, Artificial Sequence; identical to SEQ ID NO: 199762
  derived and/or modified sequence opt5 from neuraminidase__InfluenzaA__ADF27898

SEQ ID NO: 201600 - RNA, 1410 nt, Artificial Sequence; identical to SEQ ID NO: 201050
  derived and/or modified sequence opt5 from neuraminidase__InfluenzaA__ADF27908

SEQ ID NO: 201601 - RNA, 1410 nt, Artificial Sequence; identical to SEQ ID NO: 201050
  derived and/or modified sequence opt5 from neuraminidase__InfluenzaA__ADF27918

SEQ ID NO: 201602 - RNA, 1410 nt, Artificial Sequence
  derived and/or modified sequence opt5 from neuraminidase__InfluenzaA__ADF27938
augaaccccaaucagagaaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaagggagauguguuugucauucgcgagccguucaucagcuguucuccccucgaaugcagaaccuuuuuccugacacagggcgcccuucugaaugacaaacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauguccuuuuguggaguuaauagcgacacagugggcuggucuuggcccgauggggcugagcugccuuucaccauugacaaauga

SEQ ID NO: 201603 - RNA, 1410 nt, Artificial Sequence; identical to SEQ ID NO: 199762
  derived and/or modified sequence opt5 from neuraminidase__InfluenzaA__ADF27948

SEQ ID NO: 201604 - RNA, 1410 nt, Artificial Sequence; identical to SEQ ID NO: 201050
  derived and/or modified sequence opt5 from neuraminidase__InfluenzaA__ADF27958

SEQ ID NO: 201605 - RNA, 1410 nt, Artificial Sequence; identical to SEQ ID NO: 199762
  derived and/or modified sequence opt5 from neuraminidase__InfluenzaA__ADF27968

SEQ ID NO: 201606 - RNA, 1410 nt, Artificial Sequence; identical to SEQ ID NO: 201050
  derived and/or modified sequence opt5 from neuraminidase__InfluenzaA__ADF27978

SEQ ID NO: 201607 - RNA, 1410 nt, Artificial Sequence
  derived and/or modified sequence opt5 from neuraminidase__InfluenzaA__ADF27988
augaaccccaaucagaagaucauuaccaucggcagcgugugcaugacaauugggcuggccaaccucauccugcaaauuggaaauaucaucuccauuuggaucucucacagcauucagcuuggcaaccagaaucagaucgagacguguaaccaauccgucauuucuuacgaaaauaacaccuggguuaaucagacauaugugaacaucagcaauaccaacuucgcugccgggcaguccguggucucugugaaacuggcgggaaauagcucccucugcccuguuagcggcugggcuauuuacucuaaggacaacuccgugagaaucgggagcaaaggagaugucuuugugauccgggagccguucauuucuuguagcccccuggaaugccgcacauuuuuccuuacccagggcgcccugcucaaugacaagcauuccaacggcacaaucaaagauagaucuccuuaucggacccugauguccugucccauuggggagguuccuagccccuacaacucccgcuuugaaucuguggccuggagcgcuuccgccugccacgacggaaucaauuggcugacgauuggcaucagcgggccugauaacggagcugucgccgugcucaaguauaauggcaucauuaccgacacaaucaagucuuggagaaacaauauucugcggacccaagaguccgagugugcgugcgugaacgggagcuguuucacagucaugaccgauggaccgucugacggccaggccagcuacaaaaucuuucgcauugaaaagggcaaaaucguuaaguccguggagaugaaugcucccaacuaucauuacgaagagugcucuuguuacccugauagcuccgagaucacgugcgugugcagagacaauuggcacgggagcaaccggcccugggucucuuucaaucagaaccuugaauaucgcauuggauacaucuguuccggcauuuuuggggauaauccuagacccaacgacaaaacaggaagcugcggcccggugucuuccaauggggccaacggaguuaagggcuucagcuuuaaguauggcaacgggguguggaucggacggaccaaauccauuucuagccgcaauggcuucgagaugaucugggauccuaacggguggacaggaaccgacaagaauuuuuccauuaaacaggacaucgucggcaucaacgaauggucuggguacagcggcuccuucgugcaacaucccgagcugaccggacucgauuguauuagaccuugcuucuggguugaacugauccggggccgccccaaggagaauacaauuuggacgagcgggucuuccaucagcuuuuguggagugaacucugacaccgucggcugguccuggcccgauggggcugagcuuccuuucacaauugacaaauga

SEQ ID NO: 201608 - RNA, 1410 nt, Artificial Sequence; identical to SEQ ID NO: 199762
  derived and/or modified sequence opt5 from neuraminidase__InfluenzaA__ADF27998

SEQ ID NO: 201609 - RNA, 1410 nt, Artificial Sequence; identical to SEQ ID NO: 199762
  derived and/or modified sequence opt5 from neuraminidase__InfluenzaA__ADF28008

SEQ ID NO: 201610 - RNA, 1410 nt, Artificial Sequence; identical to SEQ ID NO: 200649
  derived and/or modified sequence opt5 from neuraminidase__InfluenzaA__ADF28018

SEQ ID NO: 201611 - RNA, 1410 nt, Artificial Sequence; identical to SEQ ID NO: 199762
  derived and/or modified sequence opt5 from neuraminidase__InfluenzaA__ADF28028

SEQ ID NO: 201612 - RNA, 1410 nt, Artificial Sequence
  derived and/or modified sequence opt5 from neuraminidase__InfluenzaA__ADF28038
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcuaccgggcagcuuguggucagcgugaaacuggccggaaauuccucucucugcccuguuagcggcugggcgauuuacuccaaggacaacagcaucagaaucgggucuaaaggagauguguuugucauucgggagccguucaucuccuguagcccccuggaaugccgcacauuuuuccuuacccagggcgcucugcucaaugacagacauucuaacggcacgauuaaggaucgguccccuuaucgcacccugaugagcugucccaucggggaggugccuucucccuacaacuccagauuugaaagcguugccugguccgccucugcuugccacgacggaauuaauuggcugacaaucggcaucagcgggccugauaacggagccguggcuguccucaaauauaauggcauuaucaccgacacaauuaaguccuggcggaacaauauccugcgcacccaagagagcgagugugccugcgugaacgggucuuguuucacggugaugacagauggaccguccgacggccaggcgagcuacaagauuuuuagaaucgaaaaaggcaagaucgucaaaucuguugagaugaaugcccccaacuaucauuacgaagagugcagcuguuacccugauuccucugagauuaccugcgugugccgggacaauuggcacgggagcaaccgccccuggguguccuucaaucagaaccuugaauaucagaucggauacauuuguagcggcaucuuuggggauaauccuagacccaacgacaagacaggaucuugcggcccggucuccagcaauggggcuaacggagugaaaggcuucucuuuuaaguauggcaacgggguuuggauuggacggaccaaguccaucagcucccgcaauggcuucgagaugauuugggauccuaacggguggaccggaacagacaauaacuuuucuaucaaacaagacaucgugggcauuaaugaauggagcggguacuccggcucuuucguccagcaucccgagcugacgggacucgauuguaucagaccuugcuucuggguggaacugauucggggccgccccaaggagaacaccaucuggacaagcggguccagcauuucuuuuuguggaguuaauuccgacaccgugggcuggagcuggcccgauggggccgagcuuccuuucacaaucgacaaauga

SEQ ID NO: 201613 - RNA, 1410 nt, Artificial Sequence; identical to SEQ ID NO: 199762
  derived and/or modified sequence opt5 from neuraminidase__InfluenzaA__ADF28048

SEQ ID NO: 201614 - RNA, 1410 nt, Artificial Sequence; identical to SEQ ID NO: 199762
  derived and/or modified sequence opt5 from neuraminidase__InfluenzaA__ADF28058

SEQ ID NO: 201615 - RNA, 1410 nt, Artificial Sequence
  derived and/or modified sequence opt5 from neuraminidase__InfluenzaA__ADF28068
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaucuagcucccugugcccuguuagcggcugggcuauuuacucuaaggacaauuccaucagaaucgggagcaaaggagauguguuugucauucgggagccguucaucucuuguucccaucucgaaugccgcaccuuuuuccugacacagggcgcccuucugaacgacaagcacagcaauggcaccauuaaagauagaucucccuaucggacgcucauguccuguccuaucggggaggugcccagcccuuacaacucccgcuuugaaucuguugccuggagcgcuuccgccugccaugacggaauuaacuggcugaccaucggcaucagcgggcccgauaauggagcuguggccguccugaaguauaacggcauuaucacagacaccauuaagucuuggagaaauaacauccuccggacacaagaguccgagugugcgugcgugaaugggagcuguuucaccgugaugacggauggaccuucugacggccaggccagcuacaaaauuuuucgcaucgaaaagggcaaaaucgucaaguccguugagaugaacgcuccgaauuaucacuacgaagagugcucuuguuaccccgauagcuccgagauuacaugcgugugcagagacaacuggcaugggagcaaucggccuugggugucuuucaaccagaaucuggaauaucagaucggauacauuuguuccggcaucuuuggggauaacccccgcccuaaugacaaaaagggaagcugcggccccgucucuuccaacggggccaauggagugaagggcuucagcuuuaaauauggcaacgggguuuggauuggaagaaccaaguccaucucuagccggaacggcuucgagaugauuugggauccgaauggguggacaggaaccgacaacaauuuuuccaucaaacaagacaucgugggcauuaacgaauggucuggguacagcggcuccuucguccagcacccugagcuuaccggacuggauuguauccgccccugcuucuggguggaacucauuagaggccggccuaaggagaauacaaucuggacgagcgggucuuccauuagcuuuuguggaguuaacucugacaccgugggcugguccuggcccgauggggcugagcugcccuucacaaucgacaaauga

SEQ ID NO: 201616 - RNA, 1410 nt, Artificial Sequence; identical to SEQ ID NO: 199762
  derived and/or modified sequence opt5 from neuraminidase__InfluenzaA__ADF28078

SEQ ID NO: 201617 - RNA, 1410 nt, Artificial Sequence; identical to SEQ ID NO: 199762
  derived and/or modified sequence opt5 from neuraminidase__InfluenzaA__ADF28088

SEQ ID NO: 201618 - RNA, 1410 nt, Artificial Sequence; identical to SEQ ID NO: 201224
  derived and/or modified sequence opt5 from neuraminidase__InfluenzaA__ADF28110

SEQ ID NO: 201619 - RNA, 1410 nt, Artificial Sequence; identical to SEQ ID NO: 199762
  derived and/or modified sequence opt5 from neuraminidase__InfluenzaA__ADF28120

SEQ ID NO: 201620 - RNA, 1410 nt, Artificial Sequence; identical to SEQ ID NO: 199762
  derived and/or modified sequence opt5 from neuraminidase__InfluenzaA__ADF29919

SEQ ID NO: 201621 - RNA, 1410 nt, Artificial Sequence; identical to SEQ ID NO: 200899
  derived and/or modified sequence opt5 from neuraminidase__InfluenzaA__ADF42692

SEQ ID NO: 201622 - RNA, 1410 nt, Artificial Sequence; identical to SEQ ID NO: 199762
  derived and/or modified sequence opt5 from neuraminidase__InfluenzaA__ADF42702

SEQ ID NO: 201623 - RNA, 1410 nt, Artificial Sequence; identical to SEQ ID NO: 201597
  derived and/or modified sequence opt5 from neuraminidase__InfluenzaA__ADF42712

SEQ ID NO: 201624 - RNA, 1410 nt, Artificial Sequence; identical to SEQ ID NO: 199762
  derived and/or modified sequence opt5 from neuraminidase__InfluenzaA__ADF42722

SEQ ID NO: 201625 - RNA, 1410 nt, Artificial Sequence; identical to SEQ ID NO: 201050
  derived and/or modified sequence opt5 from neuraminidase__InfluenzaA__ADF42732

SEQ ID NO: 201626 - RNA, 1410 nt, Artificial Sequence; identical to SEQ ID NO: 199762
  derived and/or modified sequence opt5 from neuraminidase__InfluenzaA__ADF42742

SEQ ID NO: 201627 - RNA, 1410 nt, Artificial Sequence; identical to SEQ ID NO: 199752
  derived and/or modified sequence opt5 from neuraminidase__InfluenzaA__ADF58339

SEQ ID NO: 201628 - RNA, 1410 nt, Artificial Sequence; identical to SEQ ID NO: 199762
  derived and/or modified sequence opt5 from neuraminidase__InfluenzaA__ADF58348

SEQ ID NO: 201629 - RNA, 1410 nt, Artificial Sequence; identical to SEQ ID NO: 199762
  derived and/or modified sequence opt5 from neuraminidase__InfluenzaA__ADF58350

SEQ ID NO: 201630 - RNA, 1410 nt, Artificial Sequence; identical to SEQ ID NO: 199762
  derived and/or modified sequence opt5 from neuraminidase__InfluenzaA__ADF58352

SEQ ID NO: 201631 - RNA, 1410 nt, Artificial Sequence
  derived and/or modified sequence opt5 from neuraminidase__InfluenzaA__ADF80459
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugaccuucaaucagaaccuggaauaccagaucggauauauuuguagcggcaucuuuggggauaauccucgccccaacgacaaaacaggaucuugcggcccggucuccagcaauggggccaacggagugaagggcuucucuuuuaaguacggcaacgggguuuggauuggaagaaccaaauccaucagcucccggaauggcuucgagaugauuugggauccuaacggguggaccggaacagacaauaacuuuucuaucaagcaagacaucgugggcauuaaugaauggagcggguauuccggcucuuucguccagcaccccgagcuuacgggacuggauuguauccgcccuugcuucuggguggaacucauuagaggccggcccaaagagaacaccguuuggacaagcggguccagcaucucuuuuuguggagucaauuccgacaccgugggcuggagcuggcccgauggggcugagcugccuuucacaauugacaaguga

SEQ ID NO: 201632 - RNA, 1410 nt, Artificial Sequence
  derived and/or modified sequence opt5 from neuraminidase__InfluenzaA__ADF80503
augaaccccaaucagaagaucauuaccaucggcagcgugugcaugacaauugggauggccaaccugauccuccaaauuggaaauaucacguccaucuggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuauuacuacgaagagugcuccuguuauccugauucuagcgagauuaccugcgugugcagagacaauuggcauggguccaaccggcccugggugagcuucaaucagaaccuggaauaccagaucggauauaucuguucuggcauuuuuggggauaauccucgccccaacgacaaaacaggauccugcggcccggucagcucuaauggggccaacggagugaagggcuucuccuuuaaguacggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguauucuggcagcuucguccagcaccccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 201633 - RNA, 1410 nt, Artificial Sequence
  derived and/or modified sequence opt5 from neuraminidase__InfluenzaA__ADF83744
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuaagcucgcugaguacagaaauugguccaaaccccagugugacauuaccggguucgccccuuuuucuaaggauaacagcauccggcuguccgcgggaggcgacaucugggugacacgcgagcccuaugucucuugcgauccugacaaguguuaccaauucgcucuugggcagggaaccacacugaauaacgugcauagcaauaacaccguuagagaucggacgccguaucgcacacuccugaugaaugaacugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggcagacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaaaucucgccucggcuaugagacauuuaaggugaucgaagggugguccaauccuaaaagcaagcugcagauuaacagacaggucaucguggaccggggaaaucgcucuggcuacuccggcauuuucagcgucgaggggaaguccuguaucaacagaugcuuuuauguggaacugauucggggaagaaaagaggaaaccgagguucucuggaccucuaauagcaucguggucuucuguggcacauccgggaccuacggaacaggcucuuggcccgauggggcugacauuaaccugaugccuaucuga

SEQ ID NO: 201634 - RNA, 1410 nt, Artificial Sequence; identical to SEQ ID NO: 200616
  derived and/or modified sequence opt5 from neuraminidase__InfluenzaA__ADF83755

SEQ ID NO: 201635 - RNA, 1410 nt, Artificial Sequence
  derived and/or modified sequence opt5 from neuraminidase__InfluenzaA__ADF83766
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguaugauaacggcguuuggaucgggagaaccaaaagcauuuccucucggaauggauucgagaugaucugggacccuaacggcuggaccgggacagacaauaacuuuagcauuaagcaagauaucgugggaaucaaugaaugguccggcuacucugggagcuucguccagcaucccgagcuuacgggccuggacuguauucgcccuugcuucuggguggaacucaucagaggacggcccaaagagaacaccauuuggacauccggcagcucuaucuccuuuugugggguuaauagcgauaccgugggauggucuuggcccgacggcgcugagcugccuuucacaauugauaaguga

SEQ ID NO: 201636 - RNA, 1410 nt, Artificial Sequence; identical to SEQ ID NO: 199762
  derived and/or modified sequence opt5 from neuraminidase__InfluenzaA__ADF83776

SEQ ID NO: 201637 - RNA, 1410 nt, Artificial Sequence
  derived and/or modified sequence opt5 from neuraminidase__InfluenzaA__ADF83786
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauggcgacacagugggguggagcuggcccgauggagcugagcugccuuucaccaucgacaaguga

SEQ ID NO: 201638 - RNA, 1410 nt, Artificial Sequence
  derived and/or modified sequence opt5 from neuraminidase__InfluenzaA__ADF83796
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugcgcauuaaugaaugguccggcuacucugggagcuucguccagcaucccgagcuuacaggccuggauuguaucagaccuugcuucuggguggaacucauucggggacgccccaaagagaacacgaucuggaccuccggcagcucuauuuccuuuugugggguuaauagcgacacagugggauggucuuggcccgauggcgcugagcugccuuucaccaucgacaaguga

SEQ ID NO: 201639 - RNA, 1410 nt, Artificial Sequence; identical to SEQ ID NO: 199762
  derived and/or modified sequence opt5 from neuraminidase__InfluenzaA__ADF83806

SEQ ID NO: 201640 - RNA, 1410 nt, Artificial Sequence; identical to SEQ ID NO: 201275
  derived and/or modified sequence opt5 from neuraminidase__InfluenzaA__ADF83816

SEQ ID NO: 201641 - RNA, 1410 nt, Artificial Sequence; identical to SEQ ID NO: 199762
  derived and/or modified sequence opt5 from neuraminidase__InfluenzaA__ADF83826

SEQ ID NO: 201642 - RNA, 1410 nt, Artificial Sequence; identical to SEQ ID NO: 199762
  derived and/or modified sequence opt5 from neuraminidase__InfluenzaA__ADF83836

SEQ ID NO: 201643 - RNA, 1410 nt, Artificial Sequence; identical to SEQ ID NO: 199762
  derived and/or modified sequence opt5 from neuraminidase__InfluenzaA__ADF83846

SEQ ID NO: 201644 - RNA, 1410 nt, Artificial Sequence; identical to SEQ ID NO: 199762
  derived and/or modified sequence opt5 from neuraminidase__InfluenzaA__ADF83856

SEQ ID NO: 201645 - RNA, 1410 nt, Artificial Sequence; identical to SEQ ID NO: 201113
  derived and/or modified sequence opt5 from neuraminidase__InfluenzaA__ADF83866

SEQ ID NO: 201646 - RNA, 1410 nt, Artificial Sequence; identical to SEQ ID NO: 201543
  derived and/or modified sequence opt5 from neuraminidase__InfluenzaA__ADF83876

SEQ ID NO: 201647 - RNA, 1410 nt, Artificial Sequence; identical to SEQ ID NO: 201193
  derived and/or modified sequence opt5 from neuraminidase__InfluenzaA__ADF83888

SEQ ID NO: 201648 - RNA, 1410 nt, Artificial Sequence
  derived and/or modified sequence opt5 from neuraminidase__InfluenzaA__ADF83898
augaaccccaaucagaagaucauuaccaucggcagcgugugcaugacaauugggauggccaaccugauccuccaaauuggaaauaucaucuccauuuggaucucucacccuauucagcugggcaaccagaaucagaucgagacguguaaccaaagcgucauuaccuacgaaaauaacacauggguuaaucagaccuaugugaacaucuccaauacaaacuucgcugccgggcagucuguggucagcgugaaacuugcgggaaauuccucucugugcccgguuagcggcugggcuauuuacuccaaggacaacagcaucagaaucgggucuaaaggagauguguuugucauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggaggugcccucuccuuacaacucccgcuuugaaagcguugccugguccgcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccgugaugacggauggacccuccgacggccaggccagcuacaaaauuuuucgcaucgaaaagggcaaaaucgucaagucuguugagaugaaugcuccuaacuaucauuacgaagagugcagcuguuaccccgauuccucugagauuacaugcgugugcagagacaauuggcacgggagcaaccggccuuggguguccuucaaucagaaccuggaauaucagaucggauacauuuguagcggcaucuuuggggauaauccccgcccgaacgacaaaaccggaucuugcggcccugucuccagcaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcugagcugccguucaccaucgacaaguga

SEQ ID NO: 201649 - RNA, 1410 nt, Artificial Sequence; identical to SEQ ID NO: 199762
  derived and/or modified sequence opt5 from neuraminidase__InfluenzaA__ADF83908

SEQ ID NO: 201650 - RNA, 1410 nt, Artificial Sequence; identical to SEQ ID NO: 199762
  derived and/or modified sequence opt5 from neuraminidase__InfluenzaA__ADF83918

SEQ ID NO: 201651 - RNA, 1410 nt, Artificial Sequence; identical to SEQ ID NO: 199762
  derived and/or modified sequence opt5 from neuraminidase__InfluenzaA__ADF84444

SEQ ID NO: 201652 - RNA, 1410 nt, Artificial Sequence; identical to SEQ ID NO: 199762
  derived and/or modified sequence opt5 from neuraminidase__InfluenzaA__ADF84462

SEQ ID NO: 201653 - RNA, 1410 nt, Artificial Sequence
  derived and/or modified sequence opt5 from neuraminidase__InfluenzaA__ADF84472
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgagcagagcguggucuccgugaaacuugcgggaaauucuagccugugcccuguuuccgggugggcuauuuacagcaaggacaacucuaucagaaucggcuccaaaggggauguguuugucauucgggaaccguucaucagcuguucuccccucgagugccgcaccuuuuuccugacacagggagcccuucugaaugacaagcauuccaacggcaccauuaaagauagaagcccuuaucggacgcucaugucuugucccaucggcgaagugccuucccccuacaacagccgcuuugaguccguugccuggucugcuagcgccugccacgacgggauuaauuggcugaccaucggaaucuccggcccugauaacggggcuguggccguccugaaguauaauggaauuaucacagacaccauuaagagcuggagaaacaauauccuccggacacaagagucugaaugugcgugcgugaacggcuccuguuucaccgugaugacggaugggccgagcgacggacaggccucuuacaaaauuuuucgcaucgagaagggcaaaaucgucaagagcguugaaaugaaugcucccaacuaucauuacgaggagugcuccuguuacccugauucuagcgaaauuacaugcgugugcagagacaauuggcacggcuccaaccggcccugggugagcuucaaucagaaccuggaguaucagaucggguacauuuguucuggaaucuuuggcgauaauccucgccccaacgacaaaaccggguccugcggaccggucagcucuaauggcgccaacggggugaagggauucuccuuuaaguauggcaacggcguuuggauugggagaacaaaaagcaucuccucucggaauggauucgaaaugauuugggauccuaacggcuggaccgggaccgacaauaacuuuagcaucaagcaagacaucgugggaauuaaugagugguccggcuacucugggagcuucguccagcaucccgaacuuacaggccuggauuguauccgcccuugcuucuggguggagcucauuagaggacggcccaaagagaacacgaucuggaccuccggcagcucuauuuccuuuugugggguuaauagcgacacagugggauggucuuggcccgauggcgcugaacugccuuucaccaucgacaaguga

SEQ ID NO: 201654 - RNA, 1410 nt, Artificial Sequence
  derived and/or modified sequence opt5 from neuraminidase__InfluenzaA__ADF84482
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuugcuaucaagcaagacauugugggcaucaaugaauggagcggguacuccggcucuuucguccagcaucccgagcuuaccggacuggauuguauucgcccuugcuucuggguggaacucaucagaggccggcccaaagagaacacaauuuggacgagcggguccagcaucucuuuuuguggaguuaauuccgacaccgugagcuggucuuggcccgauggcgccgagcugccuuucacaaucgacaaguga

SEQ ID NO: 201655 - RNA, 1410 nt, Artificial Sequence
  derived and/or modified sequence opt5 from neuraminidase__InfluenzaA__ADF84492
augaaccccaaucagaagaucauuaccaucggcagcgugugcaugacaauugggauggccaaccugauccuccaaauuggaaauaucaucuccauuuggaucucucacagcauucagcugggcaaccaggaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcccuguuuccggcugggcuauuuacagcaaggauaauucuaucagaaucggguccaaaggagacguguuugucauucgggagccguucaucagcuguucuccccucgaaugccgcaccuuuuuccugacacagggcgcccuucugaacgauaagcauuccaauggcaccauuaaagacagaagcccuuaucggacgcucaugucuugucccaucggggaggugccuucccccuacaacagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaauggagugaagggcuucuccuuuaaguauggcaacgggguuuggauuggaagaacaaaaagcaucuccucucggaacggcuucgagaugauuugggacccuaauggguggaccggaaccgacaacaauuuuagcaucaagcaagauaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 201656 - RNA, 1410 nt, Artificial Sequence; identical to SEQ ID NO: 200869
  derived and/or modified sequence opt5 from neuraminidase__InfluenzaA__ADF85020

SEQ ID NO: 201657 - RNA, 1410 nt, Artificial Sequence; identical to SEQ ID NO: 199762
  derived and/or modified sequence opt5 from neuraminidase__InfluenzaA__ADF87155

SEQ ID NO: 201658 - RNA, 1410 nt, Artificial Sequence
  derived and/or modified sequence opt5 from neuraminidase__InfluenzaA__ADF87165
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgauaagggcaaaauugucaagagcguugaaaugaaugcucccaacuaucauuacgaggaaugcuccuguuacccugacucuagcgagaucacgugcgugugcagagauaauuggcacggguccaaccggcccugggugagcuucaaucagaaccuggaguaucagauuggauacaucuguucuggcauuuuuggggacaauccucgccccaacgauaaaacaggauccugcggcccggucagcucuaauggggccaacggagugaagggcuucuccuuuaaguauggcaacgggguuuggaucggaagaaccaaaagcauuuccucucggaauggcuucgaaaugaucugggacccuaacggguggacaggaaccgacaauaacuuugcuaucaagcaagauauugugggcaucaaugaguggagcggguacuccggcucuuucguccagcaucccgaacuuaccggacuggacuguauucgcccuugcuucuggguggagcucaucagaggccggcccaaagaaaacacaauuuggacgagcggguccagcaucucuuuuuguggaguuaauuccgauaccgugggcuggagcuggcccgacggggccgagcugccuuucacaaucgauaaguga

SEQ ID NO: 201659 - RNA, 1410 nt, Artificial Sequence; identical to SEQ ID NO: 201653
  derived and/or modified sequence opt5 from neuraminidase__InfluenzaA__ADF87175

SEQ ID NO: 201660 - RNA, 1410 nt, Artificial Sequence; identical to SEQ ID NO: 199762
  derived and/or modified sequence opt5 from neuraminidase__InfluenzaA__ADF87185

SEQ ID NO: 201661 - RNA, 1410 nt, Artificial Sequence; identical to SEQ ID NO: 201653
  derived and/or modified sequence opt5 from neuraminidase__InfluenzaA__ADF87195

SEQ ID NO: 201662 - RNA, 1410 nt, Artificial Sequence; identical to SEQ ID NO: 199762
  derived and/or modified sequence opt5 from neuraminidase__InfluenzaA__ADF87205

SEQ ID NO: 201663 - RNA, 1410 nt, Artificial Sequence; identical to SEQ ID NO: 199762
  derived and/or modified sequence opt5 from neuraminidase__InfluenzaA__ADF87215

SEQ ID NO: 201664 - RNA, 1410 nt, Artificial Sequence
  derived and/or modified sequence opt5 from neuraminidase__InfluenzaA__ADF87235
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaucuccucuagaaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguauccggccuugcuucuggguggaacucauucgcggcagacccaaggagaacacgaucuggaccuccgggagcucuauuuccuuuuguggaguuaauagcgacacagugggcuggucuuggcccgauggggcugagcugccuuucaccaucgacaaauga

SEQ ID NO: 201665 - RNA, 1410 nt, Artificial Sequence; identical to SEQ ID NO: 201653
  derived and/or modified sequence opt5 from neuraminidase__InfluenzaA__ADF87245

SEQ ID NO: 201666 - RNA, 1410 nt, Artificial Sequence; identical to SEQ ID NO: 201653
  derived and/or modified sequence opt5 from neuraminidase__InfluenzaA__ADF87265

SEQ ID NO: 201667 - RNA, 1410 nt, Artificial Sequence
  derived and/or modified sequence opt5 from neuraminidase__InfluenzaA__ADF87285
augaaccccaaucagaagaucauuaccaucggcagcgugugcauguccauugggauggccaaccugauccuccaaauuggaaauaucaucucuauuuggaucagccacuccauucagcugggcaacaaaaaucagaucgagacauguaaccagucugucauuacguacgaaaauaacaccuggguuaaucaaacauaugugaacaucagcaauaccaacuucgcugccgggcaguccguggucucugugaaacuugcgggaaauagcucccugugcccuguuagcggcugggcuauuuacucuaaggacaacuccaucagaaucgggagcaagggagauguguuugucauucgggagccguucaucucuuguagcccccucgaaugccgcacauuuuuccugacccagggcgcccuucugaaugacaaacauuccaacggcacaauuaaggauagaucuccuuaucggacccucauguccugucccaucggggaggugccuagccccuacaacucccgcuuugaaucuguugccuggagcgcuuccgccugccacgacggaauuaauuggcugacgaucggcaucagcgggccugauaacggagcuguggccguccugaaguauaauggcauuaucaccgacacaauuaaaucuuggagaaacaauauccuccggacccaggaguccgagugugcgugcgugaacgggagcuguuucacagugaugaccgauggaccgucugacggccaagccagcuacaagauuuuucgcaucgaaaaaggcaagaucgucaaauccguugagaugaaugcucccaacuaucauuacgaagagugcucuuguuacccugauagcuccgagauuacgugcgugugcagagacaauuggcacgggagcaaccggcccugggugucuuucaaucagaaccuggaauaucagaucggauacauuuguuccggcaucuuuggggauaauccucgccccaacgacaagaagggaagcugcggcccggucucuuccaauggggccaacggagugaaaggcuucagcuuuaaguauggcaacgggguuuggauuggaagaacaaaauccaucucuagccggaauggcuucgagaugauuugggauccuaacggguggaccggaacagacaauaacuuuuccaucaagcaggacaucgugggcaugaaugaauggucuggguacagcggcuccuucguccaacaucccgagcuuaccggacuggauuguauucgcccuugcuucuggguggaacucaucagaggccggcccaaagagaacaccauuuggacaagcgggucuuccaucagcuuuuguggaguuaauucugacacggugggcugguccuggcccgauggggcugagcugccuuucaccauugacaaguga

SEQ ID NO: 201668 - RNA, 1410 nt, Artificial Sequence; identical to SEQ ID NO: 199762
  derived and/or modified sequence opt5 from neuraminidase__InfluenzaA__ADF87295

SEQ ID NO: 201669 - RNA, 1410 nt, Artificial Sequence; identical to SEQ ID NO: 199762
  derived and/or modified sequence opt5 from neuraminidase__InfluenzaA__ADF87305

SEQ ID NO: 201670 - RNA, 1410 nt, Artificial Sequence; identical to SEQ ID NO: 199762
  derived and/or modified sequence opt5 from neuraminidase__InfluenzaA__ADF87334

SEQ ID NO: 201671 - RNA, 1410 nt, Artificial Sequence; identical to SEQ ID NO: 199762
  derived and/or modified sequence opt5 from neuraminidase__InfluenzaA__ADF87344

SEQ ID NO: 201672 - RNA, 1410 nt, Artificial Sequence
  derived and/or modified sequence opt5 from neuraminidase__InfluenzaA__ADF87354
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauuacuuuagcaucaagcaagacaucgugggcauuaacgaaugguccggguauucuggcagcuucguccagcaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 201673 - RNA, 1410 nt, Artificial Sequence; identical to SEQ ID NO: 200345
  derived and/or modified sequence opt5 from neuraminidase__InfluenzaA__ADF87364

SEQ ID NO: 201674 - RNA, 1410 nt, Artificial Sequence; identical to SEQ ID NO: 199762
  derived and/or modified sequence opt5 from neuraminidase__InfluenzaA__ADF87374

SEQ ID NO: 201675 - RNA, 1410 nt, Artificial Sequence
  derived and/or modified sequence opt5 from neuraminidase__InfluenzaA__ADF87384
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 201676 - RNA, 1410 nt, Artificial Sequence; identical to SEQ ID NO: 199762
  derived and/or modified sequence opt5 from neuraminidase__InfluenzaA__ADF97251

SEQ ID NO: 201677 - RNA, 1410 nt, Artificial Sequence; identical to SEQ ID NO: 201005
  derived and/or modified sequence opt5 from neuraminidase__InfluenzaA__ADF97252

SEQ ID NO: 201678 - RNA, 1410 nt, Artificial Sequence; identical to SEQ ID NO: 199762
  derived and/or modified sequence opt5 from neuraminidase__InfluenzaA__ADF97253

SEQ ID NO: 201679 - RNA, 1410 nt, Artificial Sequence; identical to SEQ ID NO: 199762
  derived and/or modified sequence opt5 from neuraminidase__InfluenzaA__ADF97254

SEQ ID NO: 201680 - RNA, 1410 nt, Artificial Sequence
  derived and/or modified sequence opt5 from neuraminidase__InfluenzaA__ADF97255
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaaucauuuuagcaucaagcaagacaucgugggcauuaacgaaugguccggguacucuggcagcuucguccagcaccccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 201681 - RNA, 1410 nt, Artificial Sequence; identical to SEQ ID NO: 199762
  derived and/or modified sequence opt5 from neuraminidase__InfluenzaA__ADF97256

SEQ ID NO: 201682 - RNA, 1410 nt, Artificial Sequence; identical to SEQ ID NO: 199762
  derived and/or modified sequence opt5 from neuraminidase__InfluenzaA__ADF97257

SEQ ID NO: 201683 - RNA, 1410 nt, Artificial Sequence; identical to SEQ ID NO: 200116
  derived and/or modified sequence opt5 from neuraminidase__InfluenzaA__ADF97837

SEQ ID NO: 201684 - RNA, 1410 nt, Artificial Sequence; identical to SEQ ID NO: 199762
  derived and/or modified sequence opt5 from neuraminidase__InfluenzaA__ADG08120

SEQ ID NO: 201685 - RNA, 1350 nt, Artificial Sequence
  derived and/or modified sequence opt5 from neuraminidase__InfluenzaA__ADG21408
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccgggaaucugucccucugcccggucucuggaugggcgguguacagcaaagauaacuccaucagaauuggcagccgcggggacguuuuugugauccgggagcccuucauuucuuguucccaucuggaaugcagaaccuuuuuccuuacacaaggagcucugcucaaugauaagcacagcaacggcaccgucaaagaccggucuccucaucgcacacugauguccugucccgugggcgaggccccuagccccuauaauucuagauuugaauccguugccuggagcgcuuccgccugccacgaugggaccucuuggcugacgaucggaaucagcggcccugacaacggggcuguggccguccucaaguacaauggaauuaucaccgauacaauuaaguccuggcggaacaauaucaugcgcacccaggagagcgagugugcgugcgugaacggcucuuguuucacagugaugaccgacgggccguccagcggacaggccucuuauaaaauuuuuaagauggaaaaaggcaaggucguuaaaagcguggagcuggaugcucccaauuaccauuaugaagagugcuccuguuacccugacgccggcgagaucacgugcgugugcagagauaacuggcacgggucuaaccggcccugggucagcuucaaucagaaccuugaauaucaaaucggauacauuuguuccggcguguuuggggacaauccucgccccaacgauggaacaggcagcugcgggccgguuuucccuaauggagcuuacggcgugaagggcuuuucuuucaaguaugggaacggagucuggaucggcagaaccaaauccacaaauagccggucuggguuugagaugauuugggaccccaacggauggaccggcaccgacuccagcuucuccgugaagcaggauaucguugccauuacagacuggucuggguacagcggcuccuucgugcagcacccugaacugacgggacucgauuguauccgccccugcuuuugggucgagcugaucagaggccggcccaaagaaucuaccauuuggacaagcggguccagcaucucuuucuguggagugaauggcgacaccgucuccuggagcuggccugauggggcggagcuuccguuuacaauugacaaguga

SEQ ID NO: 201686 - RNA, 1350 nt, Artificial Sequence; identical to SEQ ID NO: 200047
  derived and/or modified sequence opt5 from neuraminidase__InfluenzaA__ADG21409

SEQ ID NO: 201687 - RNA, 1350 nt, Artificial Sequence; identical to SEQ ID NO: 200047
  derived and/or modified sequence opt5 from neuraminidase__InfluenzaA__ADG21415

SEQ ID NO: 201688 - RNA, 1350 nt, Artificial Sequence; identical to SEQ ID NO: 200047
  derived and/or modified sequence opt5 from neuraminidase__InfluenzaA__ADG21417

SEQ ID NO: 201689 - RNA, 1350 nt, Artificial Sequence
  derived and/or modified sequence opt5 from neuraminidase__InfluenzaA__ADG21419
augaaccccaaucagaagaucauuaccaucggcagcauuugcauggugaucgggauugucucccugaugcuccaaaucggaaacaugaucucuauuuggguuagccacuccauccagacaggcaaucagugucaggacgagucuauuagcaacacgaaauuccugaccgaaaaggccguggcuuccgugacacuugccggaaauucuagccugugcccuaucuccgggugggcggucuacagcaaagauaacucuauuagaaucggcucccgcggggacguguuuguuauucgggagccguucaucagcuguucucaucucgaaugcagaaccuuuuuccugacacaaggagcccuucugaaugauaagcacuccaacggcaccgugaaagaccggagcccccaucgcacacucaugucuuguccugucggcgaggcucccuccccuuauaauagcagauuugaauccguggccuggucugcuagcgccugccacgaugggaccuccuggcugacgaucggaauuagcggccccgacaacggggcuguugccgugcugaaguacaauggaaucauuaccgauacaaucaagucuuggcggaacaauauuaugcgcacccaggaguccgagugugcgugcgucaacggcagcuguuucacagugaugaccgacgggccuucuagcggacaggccuccuauaaaaucuuuaagauggaaaaaggcaagguggucaaaucuguugagcucgaugcuccgaauuaccauuaugaagagugcagcuguuaccccgacgccggcgagaucacgugcgugugcagagauaacuggcacggguccaaccggccuugggugagcuucaaucagaaccuggaauaucaaauuggauacaucuguucuggcgucuuuggggacaauccccgcccuaacgauggaacaggcuccugcgggcccguguucccgaauggagcuuacggcguuaagggcuuuagcuucaaguaugggaacggaguguggauuggcagaaccaaaucuacaaauucccggagcggguuugagaugaucugggacccuaacggauggaccggcaccgacuccucuuucagcgucaagcaggauauuguggccaucacagacugguccggguacucuggcagcuucguucagcaccccgaacuuacgggacuggauuguauccgcccuugcuuuuggguggagcucauuagaggccggcccaaagaauccaccaucuggacaagcgggucuuccauuagcuucuguggagucaauggcgacaccgugucuugguccuggcccgauggggcggagcugccuuuuacaaucgacaaguga

SEQ ID NO: 201690 - RNA, 1350 nt, Artificial Sequence
  derived and/or modified sequence opt5 from neuraminidase__InfluenzaA__ADG21423
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauagcuggcacggguccaaccggcccugggugagcuucaaccagaaucuggaauaucaaauuggauacaucuguucuggcgucuuuggggacaacccucgccccaaugauggaacaggcuccugcgggccgguguucccuaacggagcuuacggcguuaagggcuuuagcuucaaguaugggaauggaguguggauuggcagaaccaaaucuacaaacucccggagcggguuugagaugaucugggaccccaauggauggaccggcaccgacuccucuuucagcgucaagcaggauauuguggccaucacagacugguccggguacucuggcagcuucguucagcacccugaacuuacgggacuggauuguauccgccccugcuuuuggguggagcucauuagaggccggcccaaagaauccaccaucuggacaagcgggucuuccauuagcuucuguggagucaacggcgacaccgugucuugguccuggccugauggggcggagcugccguuuacaaucgacaaguga

SEQ ID NO: 201691 - RNA, 1350 nt, Artificial Sequence
  derived and/or modified sequence opt5 from neuraminidase__InfluenzaA__ADG21424
augaaccccaaucagaagaucauuaccaucggcagcauuugcauggugaucgggauugccucccugaugcuccaaaucggaaacaugaucucuauuugggucagccacuccauccagacaggcaaucagugucaggacgagucuauuagcaacacgaaauuccugaccgaaaaggcuguugccuccgugacacuugcgggaaauucuagccugugcccuaucuccgggugggcuguguacagcaaagauaacucuauuagaaucggcuccaagggggacgucuuugugauucgggagccguucaucagcuguucucaucucgaaugccgcaccuuuuuccugacacaaggagcccuucugaaugauaaacacuccaacggcaccguuaaggacagaagcccccaucggacacucaugucuuguccugugggcgaggcccccuccccuuauaauagccgcuuugaauccgucgcuuggucugccagcgcuugccacgaugggaccuccuggcugacgaucggaauuagcggccccgacaacggggccguggcgguucugaaguacaauggaaucauuaccgauacaaucaaaucuuggagaaacaauauuaugcggacccaggaguccgagugugccugcgugaacggcagcuguuucacagucaugaccgacgggccuucuagcggacaggcuuccuauaagaucuuuaaaauggaaaagggcaaaguggugaagucugucgagcucgaugccccgaauuaccauuaugaagagugcagcuguuaccccgacgcuggcgagaucacgugcguuugccgcgauaacuggcacggguccaacagaccuugggugagcuucaaucagaaccuggaauaucaaauuggauacaucuguucuggcguguuuggggacaauccccggccuaacgauggaacaggcuccugcgggcccgucuucccgaauggagccuacggcgugaagggcuuuagcuucaaauaugggaacggaguuuggauuggccgcaccaagucuacaaauuccagaagcggguuugagaugaucugggacccuaacggauggaccggcaccgacuccucuuucagcgugaaacaggauauugucgcgaucacagacugguccggguacucuggcagcuucgugcagcaccccgaacuuacgggacuggauuguauccggccuugcuuuuggguugagcucauucgcggcagacccaaggaauccaccaucuggacaagcgggucuuccauuagcuucuguggagugaauggcgacaccgucucuugguccuggcccgauggggccgagcugccuuuuacaaucgacaaauga

SEQ ID NO: 201692 - RNA, 1350 nt, Artificial Sequence
  derived and/or modified sequence opt5 from neuraminidase__InfluenzaA__ADG21426
augaaccccaaucagaagaucauuaccaucggcagcauuugcauggugaucgggauugucucccugaugcuccaaaucggaaacaugaucucuauuuggguuagccacuccauccagacagagaaucagugucaggacgaaccuauuucuaacacgaaauuccugaccgagaaggccguggcuagcgugacacuugccggcaauuccucucugugcccgaucagcgggugggcggucuacuccaaagauaacagcauuagaaucggaucucggggcgacguguuuguuauucgcgaacccuucaucuccuguagccaucucgagugcagaaccuuuuuccugacacaaggggcccuucugaaugauaagcacucuaacggaaccgugaaagaccgguccccucaucgcacacucaugagcugucccgucggcgaagcuccuucucccuauaauuccagauuugagagcguggccugguccgcuucugccugccacgauggcaccagcuggcugacgaucgggauuuccggaccugacaacggcgcuguugccgugcugaaguacaaugggaucauuaccgauacaaucaagagcuggcggaacaauauuaugcgcacccaggagucugaaugugcgugcgucaacggauccuguuucacagugaugaccgacggcccgagcucugggcaggccagcuauaaaaucuuuaagauggagaaaggaaagguggucaaauccguugaacucgaugcucccaauuaccauuaugaggagugcucuuguuacccugacgccggcgaaaucacgugcgugugcagagauaacuggcacggcagcaaccggcccuggguguccuucaaucagaaccuggaguaucaaauuggguacaucuguagcggagucuuuggcgacaauccucgccccaacgaugggacaggaucuugcggcccgguguucccuaauggggcuuacggaguuaagggcuuuuccuucaaguauggcaacgggguguggauuggaagaaccaaaagcacaaauucucgguccggcuuugaaaugaucugggaccccaacggguggaccggaaccgacagcuccuucucuguccgccaggauauuguggccaucacagacuggagcggcuacuccgggucuuucguucagcacccugagcuuacgggccuggauuguaucagacccugcuuuuggguggaacucauucggggacgccccaaggagagcaccaucuggacauccggcagcucuauuuccuucuguggggucaauggagacaccgugagcuggucuuggccugauggcgcggagcugccguuuacaaucgacaaauga

SEQ ID NO: 201693 - RNA, 1350 nt, Artificial Sequence
  derived and/or modified sequence opt5 from neuraminidase__InfluenzaA__ADG21428
augaaccccaaucagaagaucauuaccaucggcagcauuugcauggugaucgggauugucucccugaugcuccaaaucggaaacaugaucucuauuuggguuagccacccuauccagacaggcaaucagugucaggacaaaccgauuuccaacacgaaguuccugaccgagaaagccguggcuucugugacacuugccgggaauagcucccugugccccaucucuggaugggcggucuacagcaaggauaacuccauuagaaucggcagccgcggggacguguuuguuauucgggaaccuuucaucucuuguucccaucucgagugcagaaccuuuuuccugacacaaggagcccuucugaaugauaaacacagcaacggcaccgugaaggaccggucuccccaucgcacacucauguccuguccugucggcgaagcucccagcccuuauaauucuagauuugaguccguggccuggagcgcuuccgccugccacgaugggaccucuuggcugacgaucggaauuagcggcccggacaacggggcuguugccgugcugaaguacaauggaaucauuaccgauacaaucaaauccuggcggaacagcauuaugcgcacccaggaaucugagugugcgugcgucaauggcuccuguuucacagugaugaccgacgggcccagcucuggacaggccagcuauaagaucuuuaaaauggagaagggcaaaguggucaaguccguugaacucgaugcuccuaacuaccauuaugaggaaugcucuuguuaccccgacgccggcgagaucacgugcgugugcagagauaauuggcacgggagcaaccggccuuggguguccuucaaccagaaucuggaguaucaaauuggauacaucuguagcggcgucuuuggggacaacccccgcccgaaugauggaacaggcucuugcgggccuguguuccccaacggagcuuacggcguuaagggcuuuuccuucaaauaugggaauggaguguggauuggcagaaccaagagcacaaacucucgguccggguuugaaaugaucugggacccuaauggauggaccggcaccgacagcuccuucucugucaaacaggauauuguggccaucacagacuggagcggguacuccggcucuuucguucagcaccccgagcuuacgggacuggauuguauccgccccugcuuuuggguggaacucauuagaggccggccuaaggagagcaccaucuggacauccgggagcucuauuuccuucuguggagucaacggcgacaccgugagcuggucuuggccggauggggcggaacugcccuuuacaaucgacaaauga

SEQ ID NO: 201694 - RNA, 1350 nt, Artificial Sequence; identical to SEQ ID NO: 200047
  derived and/or modified sequence opt5 from neuraminidase__InfluenzaA__ADG21430

SEQ ID NO: 201695 - RNA, 1350 nt, Artificial Sequence
  derived and/or modified sequence opt5 from neuraminidase__InfluenzaA__ADG21432
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggguguccuucaaucagaaccuggaauaucaaauuggauacaucuguagcggcgucuuuggggacaauccucgccccaacgauggaacaggcucuugcgggccgguguucccuaauggagcuuacggcguuaagggcuuuuccuucagauaugggaacggaguguggauuggccggaccaagagcacaaauucucgcuccggguuugagaugaucugggaccccaacggauggaccggcaccgacagcuccuucucugucaaacaggauauuguggccaucacagacuggagcggguacuccggcucuuucguucagcacccugaacuuacgggacuggauuguaucagacccugcuuuuggguggagcucauucggggccgccccaaggaaagcaccaucuggacauccgggagcucuauuuccuucuguggagucaauggcgacaccgugagcuggucuuggccugauggggcggagcugccguuuacaaucgacaaauga

SEQ ID NO: 201696 - RNA, 1350 nt, Artificial Sequence
  derived and/or modified sequence opt5 from neuraminidase__InfluenzaA__ADG21438
augaaccccaaucagaagaucauuaccaucggcagcauuugcauggugaucgggauugucucccugaugcuccaaaucggaaacaugaucucuauuuggaucagccacuccauucagacaggcaaucagugucaggacgagccuaucucuaacacgaaauuccugaccgaaaaggccguugcuagcgugacacuugccggaaauuccucucugugcccgauuagcgggugggcgguguacuccaaagauaacagcaucagaauuggcucucgcggggacgucuuugugauccgggagcccuucaucuccuguagccaucucgaaugcagaaccuuuuuccugacacaaggagcccuucugaaugauaagcacucuaacggcaccguuaaagaccgguccccucaucgcacacucaugagcugucccgugggcgaggcuccuucucccuauaauuccagauuugaaagcgucgccugguccgcuucugccugccacgaugggaccagcuggcugacgauuggaaucuccggcccugacaacggggcuguggccguucugaaguacaauggaauuaucaccgauacaauuaagagcuggcggaacaauaucaugcgcacccaggagucugagugugcgugcgugaacggcuccuguuucacagucaugaccgacgggccgagcucuggacaggccagcuauaaaaucuuuaagauggaaaaaggcaagguggugaaauccgucgagcucgaugcucccaauuaccauuaugaagagugcucuuguuacccugacgccggcgagauuacgugcguuugcagagauaacuggcacgggagcaaccggcccuggguguccuucaaucagaaccuggaauaucaaaucggauacauuuguagcggcguguuuggggacaauccucgccccaacgauggaacaggcucuugcgggccggucuucccuaauggagcuuacggcgugaagggcuuuuccuucaaguaugggagcggaguuuggaucggcagaaccaaaucuacaaacucccggagcggguuugagaugauuugggaccccaauggauggaccggcaccgacuccucuuucagcgugaagcaggauaucgucgccaucacagacugguccggguacucuggcagcuucgugcagcacccugaacuuacgggacuggauuguauucgccccugcuuuuggguugagcucaucagaggccggcccaaagaauccaccauuuggacaagcgggucuuccaucagcuucuguggagugaacggcgacaccgucucuugguccuggccugauggggcggagcugccguuuacaauugacaaguga

SEQ ID NO: 201697 - RNA, 1350 nt, Artificial Sequence
  derived and/or modified sequence opt5 from neuraminidase__InfluenzaA__ADG21440
augaaccccaaucagaagaucauuaccaucggcagcauuugcauggugaucgggauugccucccugaugcuccaaaucggaaacaugaucucuauuugggucagccacuccauccagacaggcaaucagugucaggacgagucuauuagcaacacgaaauuccugaccgaaaaggcuguugccuccgugacacuugcgggaaauucuagccugugcccuaucuccgggugggcuguguacagcaaagauaacucuauuagaaucggcucccgcggggacgucuuugugauucgggagccguucaucagcuguucucaucucgaaugcagaaccuuuuuccugacacaaggagcccuucugaaugauaagcacuccaacggcaccguuaaagaccggagcccccaucgcacacucaugucuuguccugugggcgaggcccccuccccuuauaauagcagauuugaauccgucgcuuggucugccagcgcuugccacgaugggaccuccuggcugacgaucggaauuagcggccccgacaacggggccguggcgguucugaaguacaauggaaucauuaccgauacaaucaagucuuggcggaacaauauuaugcgcacccaggaguccgagugugccugcgugaacggcagcuguuucacagucaugaccgacgggccuucuagcggacaggcuuccuauaaaaucuuuaagauggaaaaaggcaagguggugaaaucugucgagcucgaugccccgaauuaccauuaugaagagugcagcuguuaccccgacgcuggcgagaucacgugcguuugcagagauaacuggcacggguccaaccggccuugggugagcuucaaucagaaccuggaauaucaaauuggauacaucuguucuggcguguuuggggacaauccccgcccuaacgauggaacaggcuccugcgggcccgucuucccgaauggagccuacggcgugaagggcuuuagcuucaaguaugggaacggaguuuggauuggcagaaccaaaucuacaaauucccggagcggguuugagaugaucugggacccuaacggauggaccggcaccgacuccucuuucagcgugaagcaggauauugucgcgaucacagacugguccggguacucuggcagcuucgugcagcaccccgaacuuacgggacuggauuguauccgcccuugcuuuuggguugagcucauuagaggccggcccaaagaauccaccaucuggacaagcgggucuuccauuagcuucuguggagugaauggcgacaccgucucuugguccuggcccgauggggccgagcugccuuuuacaaucgacaaguga

SEQ ID NO: 201698 - RNA, 1350 nt, Artificial Sequence; identical to SEQ ID NO: 200047
  derived and/or modified sequence opt5 from neuraminidase__InfluenzaA__ADG21442

SEQ ID NO: 201699 - RNA, 1350 nt, Artificial Sequence
  derived and/or modified sequence opt5 from neuraminidase__InfluenzaA__ADG21444
augaaccccaaucagaagaucauuaccaucggcagcauuugcauggugaucgggauugucucccugaugcuccaaaucggaaacaugaucucuauuuggguuagccacuccauccagacaggcaaucagugucaggacgagucuauuagcaacacgaaauuccugaccgaaaaggccgugacauccgugacccuugcuggaaauucuagccugugcccuaucuccgggugggccgucuacagcaaagauaacucuauuagaaucggcucccgcggggacguguuuguuauucgggagccguucaucagcuguucucaucucgaaugcagaacauuuuuccugacccaaggagcgcuucugaaugauaagcacuccaacggcacagugaaagaccggagcccccaucgcacccucaugucuuguccugucggcgaggcucccuccccuuauaauagcagauuugaauccguggccuggucugccagcgcuugccacgaugggacguccuggcugaccaucggaauuagcggccccgacaacggggccguugcugugcugaaguacaauggaaucauuacagauaccaucaagucuuggcggaacaauauuaugcgcacacaggaguccgagugugccugcgucaacggcagcuguuucaccgugaugacggacgggccuucuagcggacaggcguccuauaaaaucuuuaagauggaaaaaggcaagguggucaaaucuguugagcucgaugccccgaauuaccauuaugaagagugcagcuguuaccccgacgcuggcgagaucacaugcgugugcagagauaacuggcacggguccaaccggccuuggauuagcuucaaucagaaccuggaauaucaaaucggauacauuuguucuggcguguuuggggacaauccccgcccuaacgauggaaccggcuccugcgggcccgucuucccgaauggagccuacggcgugaagggcuuuagcuucaaguaugggaacggaguuuggaucggcagaacaaaaucuaccaauucccggagcggguuugagaugauuugggacccuaacggauggaccggcacagacuccucuuucagcgugaagcaggauaucgucgcuaucacggacugguccggguacucuggcagcuucgugcagcaccccgaacuuaccggacuggauuguauucgcccuugcuuuuggguugagcucaucagaggccggcccaaagaauccacaauuuggaccagcgggucuuccaucagcuucuguggagugaauggcgacacagucucuugguccuggcccgauggggccgagcugccuuuuaccauugacaaguga

SEQ ID NO: 201700 - RNA, 1350 nt, Artificial Sequence; identical to SEQ ID NO: 200047
  derived and/or modified sequence opt5 from neuraminidase__InfluenzaA__ADG21446

SEQ ID NO: 201701 - RNA, 1350 nt, Artificial Sequence
  derived and/or modified sequence opt5 from neuraminidase__InfluenzaA__ADG21448
augaaccccaaucagaagaucauuaccaucggcagcauuugcauggugaucgggauugucucccugaugcuccaaaucggaaacaugaucucuauuuggguuagccacuccauccagacaggcaaucagugucaggacgagccuauuucuaacacgaaauuccugaccgaaaaggccguggcuagcgugacacuugccggaaauuccucucugugcccgaucagcgggugggcggucuacuccaaagauaacagcauuagaaucggcucucgcggggacguguuuguuauucgggagcccuucaucuccuguagccaucucgaaugcagaaccuuuuuccugacacaaggagcccuucugaaugauaagcacucuaacggcaccgugaaagaccgguccccucaucgcacacucaugagcugucccgucggcgaggcuccuucucccuauaauuccagauuugaaagcguggccugguccgcuucugccugccacgaugggaccagcuggcugacgaucggaauuuccggcccugacaacggggcuguugccgugcugaaguacaauggaaucauuaccgauacaaucaagagcuggcggaacaauauuaugcgcacccaggagucugagugugcgugcgucaacggcuccuguuucacagugaugaccgacgggccgagcucuggacaggccagcuauaaaaucuuuaagauggaaaaaggcaagguggucaaauccguugagcucgaugcucccaauuaccauuaugaagagugcucuuguuacccugacgccggcgagaucacgugcgugugcagagauaacuggcacgggagcaaccggcccuggauuuccuucaaucagaaccuggaauaucaaaucggauacauuuguagcggcguguuuggggacaauccucgccccaacgauggaacaggcucuugcgggccggucuucccuaauggagcuuacggcgugaagggcuuuuccuucaaguaugggaacggaguuuggaucggcagaaccaaaagcacaaauucucgguccggguuugagaugauuugggaccccaacggauggaccggcaccgacagcuccuucucugugaagcaggauaucgucgccaucacagacuggagcggguacuccggcucuuucgugcagcacccugaacuuacgggacuggauuguauucgccccugcuuuuggguugagcucaucagaggccggcccaaagaaagcaccauuuggacauccgggagcucuaucuccuucuguggagugaauggcgacaccgucagcuggucuuggccugauggggcggagcugccguuuacaauugacaaguga

SEQ ID NO: 201702 - RNA, 1350 nt, Artificial Sequence; identical to SEQ ID NO: 201701
  derived and/or modified sequence opt5 from neuraminidase__InfluenzaA__ADG21450

SEQ ID NO: 201703 - RNA, 1410 nt, Artificial Sequence; identical to SEQ ID NO: 199762
  derived and/or modified sequence opt5 from neuraminidase__InfluenzaA__ADG27797

SEQ ID NO: 201704 - RNA, 1410 nt, Artificial Sequence
  derived and/or modified sequence opt5 from neuraminidase__InfluenzaA__ADG27983
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaaccaucacuaugaagagugcuccuguuacccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacaaugggcuggucuuggcccgauggggcugagcugccuuucaccaucgacaaguga

SEQ ID NO: 201705 - RNA, 1410 nt, Artificial Sequence; identical to SEQ ID NO: 199762
  derived and/or modified sequence opt5 from neuraminidase__InfluenzaA__ADG27989

SEQ ID NO: 201706 - RNA, 1410 nt, Artificial Sequence; identical to SEQ ID NO: 201704
  derived and/or modified sequence opt5 from neuraminidase__InfluenzaA__ADG27998

SEQ ID NO: 201707 - RNA, 1410 nt, Artificial Sequence; identical to SEQ ID NO: 200116
  derived and/or modified sequence opt5 from neuraminidase__InfluenzaA__ADG28013

SEQ ID NO: 201708 - RNA, 1410 nt, Artificial Sequence; identical to SEQ ID NO: 199762
  derived and/or modified sequence opt5 from neuraminidase__InfluenzaA__ADG42086

SEQ ID NO: 201709 - RNA, 1410 nt, Artificial Sequence; identical to SEQ ID NO: 199762
  derived and/or modified sequence opt5 from neuraminidase__InfluenzaA__ADG42096

SEQ ID NO: 201710 - RNA, 1410 nt, Artificial Sequence; identical to SEQ ID NO: 201339
  derived and/or modified sequence opt5 from neuraminidase__InfluenzaA__ADG42106

SEQ ID NO: 201711 - RNA, 1410 nt, Artificial Sequence; identical to SEQ ID NO: 199762
  derived and/or modified sequence opt5 from neuraminidase__InfluenzaA__ADG42116

SEQ ID NO: 201712 - RNA, 1410 nt, Artificial Sequence; identical to SEQ ID NO: 199762
  derived and/or modified sequence opt5 from neuraminidase__InfluenzaA__ADG42126

SEQ ID NO: 201713 - RNA, 1410 nt, Artificial Sequence; identical to SEQ ID NO: 199762
  derived and/or modified sequence opt5 from neuraminidase__InfluenzaA__ADG42136

SEQ ID NO: 201714 - RNA, 1410 nt, Artificial Sequence; identical to SEQ ID NO: 200345
  derived and/or modified sequence opt5 from neuraminidase__InfluenzaA__ADG42146

SEQ ID NO: 201715 - RNA, 1410 nt, Artificial Sequence; identical to SEQ ID NO: 199762
  derived and/or modified sequence opt5 from neuraminidase__InfluenzaA__ADG42156

SEQ ID NO: 201716 - RNA, 1410 nt, Artificial Sequence; identical to SEQ ID NO: 199762
  derived and/or modified sequence opt5 from neuraminidase__InfluenzaA__ADG42166

SEQ ID NO: 201717 - RNA, 1410 nt, Artificial Sequence; identical to SEQ ID NO: 199762
  derived and/or modified sequence opt5 from neuraminidase__InfluenzaA__ADG42186

SEQ ID NO: 201718 - RNA, 1410 nt, Artificial Sequence; identical to SEQ ID NO: 201653
  derived and/or modified sequence opt5 from neuraminidase__InfluenzaA__ADG42196

SEQ ID NO: 201719 - RNA, 1410 nt, Artificial Sequence
  derived and/or modified sequence opt5 from neuraminidase__InfluenzaA__ADG42206
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcaaaauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgaaaugauuugggauccuaacggguggaccggaaccgacaauaacuuuagcaucaaacaagacaucgugggcauuaaugagugguccggguacucuggcagcuucguccagcaucccgaacuuacaggacuggauuguauccgcccuugcuucuggguggagcucauuagaggccggcccaaggaaaacacgaucuggaccuccgggagcucuauuuccuuuuguggaguuaauagcgacacagugggcuggucuuggcccgauggggcugagcugccuuucaccaucgacaaauga

SEQ ID NO: 201720 - RNA, 1410 nt, Artificial Sequence; identical to SEQ ID NO: 199762
  derived and/or modified sequence opt5 from neuraminidase__InfluenzaA__ADG42216

SEQ ID NO: 201721 - RNA, 1410 nt, Artificial Sequence; identical to SEQ ID NO: 201113
  derived and/or modified sequence opt5 from neuraminidase__InfluenzaA__ADG42226

SEQ ID NO: 201722 - RNA, 1410 nt, Artificial Sequence; identical to SEQ ID NO: 199762
  derived and/or modified sequence opt5 from neuraminidase__InfluenzaA__ADG42236

SEQ ID NO: 201723 - RNA, 1410 nt, Artificial Sequence; identical to SEQ ID NO: 199762
  derived and/or modified sequence opt5 from neuraminidase__InfluenzaA__ADG42246

SEQ ID NO: 201724 - RNA, 1410 nt, Artificial Sequence; identical to SEQ ID NO: 199762
  derived and/or modified sequence opt5 from neuraminidase__InfluenzaA__ADG42256

SEQ ID NO: 201725 - RNA, 1410 nt, Artificial Sequence; identical to SEQ ID NO: 199762
  derived and/or modified sequence opt5 from neuraminidase__InfluenzaA__ADG42276

SEQ ID NO: 201726 - RNA, 1410 nt, Artificial Sequence
  derived and/or modified sequence opt5 from neuraminidase__InfluenzaA__ADG42296
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccgggcgcaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggccgagcugccuuucacaaucgacaaguga

SEQ ID NO: 201727 - RNA, 1410 nt, Artificial Sequence; identical to SEQ ID NO: 199762
  derived and/or modified sequence opt5 from neuraminidase__InfluenzaA__ADG42306

SEQ ID NO: 201728 - RNA, 1410 nt, Artificial Sequence; identical to SEQ ID NO: 199762
  derived and/or modified sequence opt5 from neuraminidase__InfluenzaA__ADG42316

SEQ ID NO: 201729 - RNA, 1410 nt, Artificial Sequence; identical to SEQ ID NO: 199762
  derived and/or modified sequence opt5 from neuraminidase__InfluenzaA__ADG42326

SEQ ID NO: 201730 - RNA, 1410 nt, Artificial Sequence
  derived and/or modified sequence opt5 from neuraminidase__InfluenzaA__ADG42336
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccuguguccggcugggcuauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaaguuuagcaucaaacaagacaucguuggcauuaacgaaugguccggguacucuggcagcuucgugcagcaucccgagcuuacaggacuggauuguauccgcccuugcuucugggucgaacucauuagaggccggcccaaggagaauacgaucuggaccuccgggagcucuauuuccuuuuguggagugaacagcgacacaguuggcuggucuuggcccgauggggcugagcugccuuucaccaucgacaaauga

SEQ ID NO: 201731 - RNA, 1410 nt, Artificial Sequence; identical to SEQ ID NO: 201224
  derived and/or modified sequence opt5 from neuraminidase__InfluenzaA__ADG42346

SEQ ID NO: 201732 - RNA, 1410 nt, Artificial Sequence; identical to SEQ ID NO: 200939
  derived and/or modified sequence opt5 from neuraminidase__InfluenzaA__ADG42356

SEQ ID NO: 201733 - RNA, 1410 nt, Artificial Sequence
  derived and/or modified sequence opt5 from neuraminidase__InfluenzaA__ADG42366
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccuggaucagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaaguuuagcaucaaacaagacauuguuggcaucaacgaaugguccggguacucuggcagcuucgugcagcaucccgagcuuacaggacuggauuguauucgcccuugcuucugggucgaacucaucagaggccggcccaaggagaauacgauuuggaccuccgggagcucuaucuccuuuuguggagugaacagcgacacaguuggcuggucuuggcccgauggggcugagcugccuuucaccaucgacaaauga

SEQ ID NO: 201734 - RNA, 1410 nt, Artificial Sequence; identical to SEQ ID NO: 199762
  derived and/or modified sequence opt5 from neuraminidase__InfluenzaA__ADG42376

SEQ ID NO: 201735 - RNA, 1410 nt, Artificial Sequence
  derived and/or modified sequence opt5 from neuraminidase__InfluenzaA__ADG42386
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaauuugcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgaaugacggccaggccagcuacaaaauuuuccgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuuuaaccagaaucucgaauaucagaucggauacauuuguagcggcaucuucggggauaacccucgccccaaugacaaaaccggaucuugcggcccggucuccagcaacggggccaacggagugaagggcuuuucuuucaaguauggcaaugggguuuggauuggaagaacaaaauccaucagcucccggucuggcuuugagaugauuugggauccuaacggguggaccggaaccgacaauaaguucagcaucaaacaagacaucgugggcauuaacgaaugguccggguacucuggcagcuucguccagcaucccgagcugacaggacuugauuguauccgcccuugcuuuuggguggaacugauuagaggccggcccaaggagaauacgaucuggaccuccgggagcucuauuuccuucuguggaguuaacagcgacacagugggcuggucuuggcccgauggggcugagcucccuuuuaccaucgacaaauga

SEQ ID NO: 201736 - RNA, 1410 nt, Artificial Sequence; identical to SEQ ID NO: 201719
  derived and/or modified sequence opt5 from neuraminidase__InfluenzaA__ADG42396

SEQ ID NO: 201737 - RNA, 1410 nt, Artificial Sequence
  derived and/or modified sequence opt5 from neuraminidase__InfluenzaA__ADG42406
augaaccccaaucagaagaucauuaccaucggcagcgugugcaugacaauugggauggccaaccugauccuccaaauuggaaauauccuguccacguggaucucucacagcauucagcuuggcaaccagaaucagaucgagaccuguaaccaauccgucauuacauacgaaaauaacaccuggguuaaucagacauaugugaacaucucuaauaccaacuucgcugccgggcagagcguggucuccgugaaacuggcgggaaauucuagccucugcccuguuuccggcugggcuauuuacagcaaggacaacucuaucagaauuggguccaaaggagauguguuugucauccgggagccguucaucagcuguucuccccuggaaugccgcacauuuuuccuuacccagggcgcccugcucaaugacaagcauuccaacggcacgauuaaagauagaagcccuuaucggacccugaugucuugucccaucggggaggugccuucccccuacaacagccgcuuugaauccguugccuggucugcuagcgccugccacgacggaauuaauuggcugacaaucggcauuuccgggccugauaacggagcuguggccguccucaaguauaauggcaucaucaccgacacaauuaagagcuggagaaacaauauccugcggacccaagagucugagugugcgugcgugaacggguccuguuucacggugaugacagauggaccgagcgacggccaggccucuuacaaaauuuuucgcaucgaaaagggcaaaauugucaagagcguugagaugaaugcucccaacuaucauuacgaagagugcuccuguuacccugauucuagcgagauuaccugcgugugcagagacaauuggcacggguccaaccggcccugggugagcuucaaucagaaccuugaauaucagaucggauacaucuguucuggcaucuuuggggauaauccucgccccaacgacaaaaagggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaucaaacaagacauugugggcaucaaugaaugguccggguacucuggcagcuucguccagcaucccgagcugacaggacucgauuguauccgcccuugcuucuggguggaacugauuagaggccggcccaaggagaacacgaucuggaccuccgggagcucuauuuccuuuuguggaguuaauagcgacacagugggcuggucuuggcccgauggggcugagcuuccuuucaccaucgacaaauga

SEQ ID NO: 201738 - RNA, 1410 nt, Artificial Sequence; identical to SEQ ID NO: 200939
  derived and/or modified sequence opt5 from neuraminidase__InfluenzaA__ADG42426

SEQ ID NO: 201739 - RNA, 1410 nt, Artificial Sequence; identical to SEQ ID NO: 199762
  derived and/or modified sequence opt5 from neuraminidase__InfluenzaA__ADG42436

SEQ ID NO: 201740 - RNA, 1410 nt, Artificial Sequence
  derived and/or modified sequence opt5 from neuraminidase__InfluenzaA__ADG42446
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgcgaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 201741 - RNA, 1410 nt, Artificial Sequence
  derived and/or modified sequence opt5 from neuraminidase__InfluenzaA__ADG42456
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccucaccggacgcucaugucuugucccaucggggaggugccuucccccuauaacagccgcuuugaauccguugccuggucugcuagcgccugccaugacggaauuaauuggcugaccaucggcaucuccgggccugauaacggagcuguggccguccugaaguacaauggcauuaucacagacaccauuaagagcuggagaaacaauauccuccggacacaagagucugagugugcgugcgugaacggguccuguuucaccgugaugacggauggaccgagcgacggccaggccucuuauaaaauuuuucgcaucgaaaagggcaaaaucgucaagagcguugagaugaaugcucccaacuaccacuaugaagagugcuccuguuacccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 201742 - RNA, 1410 nt, Artificial Sequence; identical to SEQ ID NO: 199762
  derived and/or modified sequence opt5 from neuraminidase__InfluenzaA__ADG42466

SEQ ID NO: 201743 - RNA, 1410 nt, Artificial Sequence
  derived and/or modified sequence opt5 from neuraminidase__InfluenzaA__ADG42476
augaaccccaaucagaagaucauuaccaucggcagcgugugcaugacaauugggauggccaaccugauccuccaaauuggaaauaucaucuccauuuggaucucucacagcauucagcugggcaaccagaaucagacggagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 201744 - RNA, 1410 nt, Artificial Sequence; identical to SEQ ID NO: 201664
  derived and/or modified sequence opt5 from neuraminidase__InfluenzaA__ADG42486

SEQ ID NO: 201745 - RNA, 1410 nt, Artificial Sequence; identical to SEQ ID NO: 199762
  derived and/or modified sequence opt5 from neuraminidase__InfluenzaA__ADG42496

SEQ ID NO: 201746 - RNA, 1410 nt, Artificial Sequence
  derived and/or modified sequence opt5 from neuraminidase__InfluenzaA__ADG42506
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccaucauuacguacgaaaauaacaccugggucaaucagacauauguuaacaucucuaauaccaacuucgcugccgggcagagcgugguguccgucaaacuugcgggaaauucuagccugugcccuguguccggcugggcuaucuacagcaaggacaacucuauuagaaucggguccaaaggagauguuuuugugauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggucccuucccccuacaacagccgcuuugaauccguggccuggucugcuagcgccugccacgacggaaucaauuggcugacgauuggcaucuccgggccugauaacggagcuguugccgugcugaaguauaauggcauuaucaccgacacaauuaagagcuggagaaacaauauccuccggacccaagagucugagugugcgugcgucaacggguccuguuucacagugaugaccgauggaccgagcgacggccaggccucuuacaaaaucuuucgcauugaaaagggcaaaguggucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201747 - RNA, 1410 nt, Artificial Sequence; identical to SEQ ID NO: 200937
  derived and/or modified sequence opt5 from neuraminidase__InfluenzaA__ADG42516

SEQ ID NO: 201748 - RNA, 1410 nt, Artificial Sequence
  derived and/or modified sequence opt5 from neuraminidase__InfluenzaA__ADG42526
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugccugaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuagcgagauuacaugcguuugcagagacaauuggcacggguccaaccggcccugggugagcuucaaucagaaccuugaauaucagaucggauacauuuguucuggcaucuuuggggauaauccucgccccaacgacaaaaccggauccugcggcccggugagcucuaauggggccaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcugacaggacucgauuguauccgcccuugcuucugggucgaacugauuagaggccggcccaaagagaacacgaucuggaccuccgggagcucuauuuccuuuuguggagugaauagcgacacaguuggcuggucuuggcccgauggggcugagcuuccuuucaccaucgacaaguga

SEQ ID NO: 201749 - RNA, 1410 nt, Artificial Sequence
  derived and/or modified sequence opt5 from neuraminidase__InfluenzaA__ADG42536
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuacaagcgacaccgugggcuggucuuggcccgauggggcugagcugccuuucacaaucgacaaguga

SEQ ID NO: 201750 - RNA, 1410 nt, Artificial Sequence; identical to SEQ ID NO: 199762
  derived and/or modified sequence opt5 from neuraminidase__InfluenzaA__ADG42546

SEQ ID NO: 201751 - RNA, 1410 nt, Artificial Sequence; identical to SEQ ID NO: 199762
  derived and/or modified sequence opt5 from neuraminidase__InfluenzaA__ADG42556

SEQ ID NO: 201752 - RNA, 1410 nt, Artificial Sequence
  derived and/or modified sequence opt5 from neuraminidase__InfluenzaA__ADG42566
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcauagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccuuaucggacgcucaugucuugucccaucggggaggugccuucccccuacaacagccgcuuugaauccguugccuggucugcuagcgccugccaugacggaauuaauuggcugaccaucggcaucuccgggccugauaacggagcuguggccguccugaaguauaauggcauuaucacagacaccauuaagagcuggagaaacaauauccuccggacacaggagucugagugugcgugcgugaacggguccuguuucaccgugaugacggauggaccgagcgacggccaagccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguacucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 201753 - RNA, 1410 nt, Artificial Sequence
  derived and/or modified sequence opt5 from neuraminidase__InfluenzaA__ADG42576
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccuuauaacggagcuguggccguccugaaguacaauggcauuaucacagauaccauuaagagcuggagaaacaauauccuccggacacaagagucugagugugcgugcgugaacggguccuguuucaccgugaugacggacggaccgagcgauggccaggccucuuauaaaauuuuuaagaucgaaaaaggcaagaucgucaaaagcguugagaugaaugcucccaacuaccauuacgaagagugcuccuguuauccugacucuagcgagauuacaugcgugugccgcgauaauuggcacggguccaacagacccugggugagcuucaaucagaaccuggaauaccagaucggauauauuuguucuggcaucuuuggggacaauccucggcccaacgauaagaccggauccugcggcccggucagcucuaauggggccaacggagugaagggcuucuccuuuaaauacggcaacgggguuuggauuggacgcacaaagagcaucuccucuagaaauggcuucgagaugauuugggacccuaacggguggaccggaaccgauaauaacuuuagcaucaaacaagacaucgugggcauuaaugaaugguccggguauucuggcagcuucguccagcaucccgagcuuacaggacuggacuguauccggccuugcuucuggguggaacucauucgcggcagacccaaggagaacacgaucuggaccuccgggagcucuauuuccuuuuguggaguuaauagcgauacagugggcuggucuuggcccgacggggcugagcugccuuucaccaucgauaaauga

SEQ ID NO: 201754 - RNA, 1410 nt, Artificial Sequence; identical to SEQ ID NO: 199762
  derived and/or modified sequence opt5 from neuraminidase__InfluenzaA__ADG42586

SEQ ID NO: 201755 - RNA, 1410 nt, Artificial Sequence
  derived and/or modified sequence opt5 from neuraminidase__InfluenzaA__ADG42606
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucccgaucgacaaguga

SEQ ID NO: 201756 - RNA, 1410 nt, Artificial Sequence
  derived and/or modified sequence opt5 from neuraminidase__InfluenzaA__ADG42616
augaacagcaaucagaagaucauuaccaucggcuccgugugcaugacaauugggauggccaaccugauccuccaaauuggaaauaucaucucuauuuggaucagccacuccauucagcugggcaaccagaaucagaucgagacguguaaccaaucugucauuaccuacgaaaauaacacauggguuaaucagaccuaugugaacaucagcaauacaaacuucgcugccgggcaguccguggucucugugaaacuugcgggaaauagcucccugugccccguuagcggcugggcuauuuacucuaaggacaacuccaucagaaucgggagcaaaggagauguguuugucauucgggagccuuucaucucuuguuccccgcucgaaugccgcaccuuuuuccugacacagggcgcccuucugaaugacaagcauagcaacggcaccauuaaagauagaucucccuaucggacgcucauguccuguccuaucggggaggugcccagcccuuacaacucccgcuuugaaucuguugccuggagcgcuuccgccugccacgacggaauuaauuggcugaccaucggcaucagcgggcccgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 201757 - RNA, 1410 nt, Artificial Sequence; identical to SEQ ID NO: 200345
  derived and/or modified sequence opt5 from neuraminidase__InfluenzaA__ADG42626

SEQ ID NO: 201758 - RNA, 1410 nt, Artificial Sequence; identical to SEQ ID NO: 201743
  derived and/or modified sequence opt5 from neuraminidase__InfluenzaA__ADG42636

SEQ ID NO: 201759 - RNA, 1410 nt, Artificial Sequence
  derived and/or modified sequence opt5 from neuraminidase__InfluenzaA__ADG42646
augaaccccaaucagagaaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaagggagauguguuugucauucgcgagccguucaucagcuguucuccccucgaaugcagaaccuuuuuccugacacagggcgcccuucugaaugacaaacauuccaacggcaccauuaaggaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacggagcuguggccguccugaaauauaauggcauuaucacagacaccauuaagagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 201760 - RNA, 1410 nt, Artificial Sequence; identical to SEQ ID NO: 199762
  derived and/or modified sequence opt5 from neuraminidase__InfluenzaA__ADG42656

SEQ ID NO: 201761 - RNA, 1410 nt, Artificial Sequence; identical to SEQ ID NO: 201675
  derived and/or modified sequence opt5 from neuraminidase__InfluenzaA__ADG42666

SEQ ID NO: 201762 - RNA, 1410 nt, Artificial Sequence
  derived and/or modified sequence opt5 from neuraminidase__InfluenzaA__ADG42676
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagauuuguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccuuaucggacccucaugucuugucccauuggggaggugccuucccccuacaacagccgcuuugaauccguugccuggucugcuagcgccugccacgacggaaucaauuggcugacgaucggcauuuccgggccugauaacggagcuguggccguccugaaguauaauggcaucauuaccgacacaaucaagagcuggagaaacaauauucuccggacccaagagucugagugugcgugcgugaacggguccuguuucacagugaugaccgauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacgugcgugugcagagacaauuggcacggguccaaccggcccugggugagcuucaaucagaaccuggaauaucagauuggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguacucuggcagcuucguccagcaucccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 201763 - RNA, 1410 nt, Artificial Sequence; identical to SEQ ID NO: 199762
  derived and/or modified sequence opt5 from neuraminidase__InfluenzaA__ADG42686

SEQ ID NO: 201764 - RNA, 1410 nt, Artificial Sequence; identical to SEQ ID NO: 201339
  derived and/or modified sequence opt5 from neuraminidase__InfluenzaA__ADG42696

SEQ ID NO: 201765 - RNA, 1410 nt, Artificial Sequence; identical to SEQ ID NO: 201543
  derived and/or modified sequence opt5 from neuraminidase__InfluenzaA__ADG42706

SEQ ID NO: 201766 - RNA, 1410 nt, Artificial Sequence; identical to SEQ ID NO: 199762
  derived and/or modified sequence opt5 from neuraminidase__InfluenzaA__ADG42716

SEQ ID NO: 201767 - RNA, 1410 nt, Artificial Sequence; identical to SEQ ID NO: 201050
  derived and/or modified sequence opt5 from neuraminidase__InfluenzaA__ADG42726

SEQ ID NO: 201768 - RNA, 1410 nt, Artificial Sequence; identical to SEQ ID NO: 200345
  derived and/or modified sequence opt5 from neuraminidase__InfluenzaA__ADG42746

SEQ ID NO: 201769 - RNA, 1410 nt, Artificial Sequence; identical to SEQ ID NO: 201275
  derived and/or modified sequence opt5 from neuraminidase__InfluenzaA__ADG42756

SEQ ID NO: 201770 - RNA, 1410 nt, Artificial Sequence; identical to SEQ ID NO: 201050
  derived and/or modified sequence opt5 from neuraminidase__InfluenzaA__ADG42766

SEQ ID NO: 201771 - RNA, 1410 nt, Artificial Sequence; identical to SEQ ID NO: 201050
  derived and/or modified sequence opt5 from neuraminidase__InfluenzaA__ADG42776

SEQ ID NO: 201772 - RNA, 1410 nt, Artificial Sequence; identical to SEQ ID NO: 201050
  derived and/or modified sequence opt5 from neuraminidase__InfluenzaA__ADG42796

SEQ ID NO: 201773 - RNA, 1410 nt, Artificial Sequence
  derived and/or modified sequence opt5 from neuraminidase__InfluenzaA__ADG42806
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugucuugguccuggcccgauggcgcugagcugccuuucaccaucgacaaguga

SEQ ID NO: 201774 - RNA, 1410 nt, Artificial Sequence; identical to SEQ ID NO: 199762
  derived and/or modified sequence opt5 from neuraminidase__InfluenzaA__ADG42816

SEQ ID NO: 201775 - RNA, 1410 nt, Artificial Sequence; identical to SEQ ID NO: 199762
  derived and/or modified sequence opt5 from neuraminidase__InfluenzaA__ADG42826

SEQ ID NO: 201776 - RNA, 1410 nt, Artificial Sequence; identical to SEQ ID NO: 199762
  derived and/or modified sequence opt5 from neuraminidase__InfluenzaA__ADG42836

SEQ ID NO: 201777 - RNA, 1410 nt, Artificial Sequence; identical to SEQ ID NO: 201378
  derived and/or modified sequence opt5 from neuraminidase__InfluenzaA__ADG42846

SEQ ID NO: 201778 - RNA, 1410 nt, Artificial Sequence; identical to SEQ ID NO: 199762
  derived and/or modified sequence opt5 from neuraminidase__InfluenzaA__ADG42856

SEQ ID NO: 201779 - RNA, 1410 nt, Artificial Sequence; identical to SEQ ID NO: 201374
  derived and/or modified sequence opt5 from neuraminidase__InfluenzaA__ADG42866

SEQ ID NO: 201780 - RNA, 1410 nt, Artificial Sequence; identical to SEQ ID NO: 199762
  derived and/or modified sequence opt5 from neuraminidase__InfluenzaA__ADG42876

SEQ ID NO: 201781 - RNA, 1410 nt, Artificial Sequence; identical to SEQ ID NO: 201411
  derived and/or modified sequence opt5 from neuraminidase__InfluenzaA__ADG42886

SEQ ID NO: 201782 - RNA, 1410 nt, Artificial Sequence; identical to SEQ ID NO: 201354
  derived and/or modified sequence opt5 from neuraminidase__InfluenzaA__ADG42896

SEQ ID NO: 201783 - RNA, 1410 nt, Artificial Sequence; identical to SEQ ID NO: 201354
  derived and/or modified sequence opt5 from neuraminidase__InfluenzaA__ADG42906

SEQ ID NO: 201784 - RNA, 1410 nt, Artificial Sequence; identical to SEQ ID NO: 199762
  derived and/or modified sequence opt5 from neuraminidase__InfluenzaA__ADG42916

SEQ ID NO: 201785 - RNA, 1410 nt, Artificial Sequence; identical to SEQ ID NO: 199762
  derived and/or modified sequence opt5 from neuraminidase__InfluenzaA__ADG42926

SEQ ID NO: 201786 - RNA, 1410 nt, Artificial Sequence; identical to SEQ ID NO: 199762
  derived and/or modified sequence opt5 from neuraminidase__InfluenzaA__ADG58909

SEQ ID NO: 201787 - RNA, 1410 nt, Artificial Sequence; identical to SEQ ID NO: 199762
  derived and/or modified sequence opt5 from neuraminidase__InfluenzaA__ADG58910

SEQ ID NO: 201788 - RNA, 1410 nt, Artificial Sequence
  derived and/or modified sequence opt5 from neuraminidase__InfluenzaA__ADG58913
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugaccuucaaucagaaccuggaauaucagaucggauacauuuguagcggcaucuuuggggauaauccucgccccaacgacaaaacaggaucuugcggcccggucuccagcaauggggccaacggagugaagggcuucucuuuuaaguauggcaacgggguuuggauuggaagaaccaaauccaucagcucccggaauggcuucgagaugauuugggauccuaacggguggaccggaacagacaauaacuuuucuaucaagcaagacaucgugggcauuaaugaauggagcggguacuccggcucuuucguccagcaucccgagcuuacgggacuggauuguauccgcccuugcuucuggauugaacucaucagaggccggcccaaagagaacaccauuuggacaagcggguccagcaucucuuuuuguggaguuaauuccgacaccgugggcuggagcuggcccgauggggcugagcugccuuucacaaucgacaaguga

SEQ ID NO: 201789 - RNA, 1410 nt, Artificial Sequence; identical to SEQ ID NO: 199762
  derived and/or modified sequence opt5 from neuraminidase__InfluenzaA__ADG58914

SEQ ID NO: 201790 - RNA, 1410 nt, Artificial Sequence; identical to SEQ ID NO: 199762
  derived and/or modified sequence opt5 from neuraminidase__InfluenzaA__ADG58916

SEQ ID NO: 201791 - RNA, 1410 nt, Artificial Sequence; identical to SEQ ID NO: 199762
  derived and/or modified sequence opt5 from neuraminidase__InfluenzaA__ADG58917

SEQ ID NO: 201792 - RNA, 1410 nt, Artificial Sequence
  derived and/or modified sequence opt5 from neuraminidase__InfluenzaA__ADG58918
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugaccuucaaucagaaccuggaauaucagaucggauacauuuguagcggcaucuuuggggauaauccucgccccaacgacaaaacaggaucuugcggcccggucuccagcaauggggccaacggagugaagggcuucucuuuuaaguauggcaacgggguuuggauuggaagaaccaaauccaucagcucccggaauggcuucgagaugauuugggauccuaacggguggaccggaacagacaauaacuuuucuaucaagcaagacaucgugggcauuaaugaauggagcggguacuccggcucuuucguccagcaucccgagcuuacgggacuggauuguauccgcccuugcuucuggguggaacucauuagaggccggcccaaagagaacaccaucuggacaagcggguccagcauuucuuuuuguggaguuaauuccgacaccgugggcuggagcuggcccgauggggcugagcugccuuucacaaucgacaaguga

SEQ ID NO: 201793 - RNA, 1410 nt, Artificial Sequence; identical to SEQ ID NO: 201788
  derived and/or modified sequence opt5 from neuraminidase__InfluenzaA__ADG58919

SEQ ID NO: 201794 - RNA, 1410 nt, Artificial Sequence; identical to SEQ ID NO: 199917
  derived and/or modified sequence opt5 from neuraminidase__InfluenzaA__ADG58920

SEQ ID NO: 201795 - RNA, 1410 nt, Artificial Sequence; identical to SEQ ID NO: 199917
  derived and/or modified sequence opt5 from neuraminidase__InfluenzaA__ADG58921

SEQ ID NO: 201796 - RNA, 1410 nt, Artificial Sequence; identical to SEQ ID NO: 199917
  derived and/or modified sequence opt5 from neuraminidase__InfluenzaA__ADG58922

SEQ ID NO: 201797 - RNA, 1410 nt, Artificial Sequence; identical to SEQ ID NO: 199917
  derived and/or modified sequence opt5 from neuraminidase__InfluenzaA__ADG58923

SEQ ID NO: 201798 - RNA, 1410 nt, Artificial Sequence; identical to SEQ ID NO: 199917
  derived and/or modified sequence opt5 from neuraminidase__InfluenzaA__ADG58924

SEQ ID NO: 201799 - RNA, 1410 nt, Artificial Sequence; identical to SEQ ID NO: 199917
  derived and/or modified sequence opt5 from neuraminidase__InfluenzaA__ADG58925

SEQ ID NO: 201800 - RNA, 1410 nt, Artificial Sequence; identical to SEQ ID NO: 199917
  derived and/or modified sequence opt5 from neuraminidase__InfluenzaA__ADG58926

SEQ ID NO: 201801 - RNA, 1410 nt, Artificial Sequence; identical to SEQ ID NO: 199917
  derived and/or modified sequence opt5 from neuraminidase__InfluenzaA__ADG58927

SEQ ID NO: 201802 - RNA, 1410 nt, Artificial Sequence; identical to SEQ ID NO: 200780
  derived and/or modified sequence opt5 from neuraminidase__InfluenzaA__ADG58928

SEQ ID NO: 201803 - RNA, 1410 nt, Artificial Sequence; identical to SEQ ID NO: 200780
  derived and/or modified sequence opt5 from neuraminidase__InfluenzaA__ADG58929

SEQ ID NO: 201804 - RNA, 1410 nt, Artificial Sequence
  derived and/or modified sequence opt5 from neuraminidase__InfluenzaA__ADG58931
augaaccccaaucagaagaucauuaccaucggcagcgugugcaugacaauugggauggccaaccugauccuccaaauuggaaauacgaucuccaucuggauuaaccacucuauccagcugggcaaucagaaccagauugagaccuguaaucaaagcgucaucacauacgaaaacaauaccuggguuaaccagacauaugugaauauuuccaacaccaauuucgcugccgggcagucuguggucagcgugaaacuugcgggaaacuccucucugugcccuguuagcggcugggcuaucuacuccaaggacaauagcauuagaaucgggucuaaaggagauguguuugucauccgggagccguucauuuccuguagcccccucgaaugccgcacauuuuuccugacccagggcgcccuucugaacgacaagcauucuaacggcacgaucaaagauagauccccuuaucggacccucaugagcugucccauuggggaggugccuucucccuacaauucccgcuuugaaagcguugccugguccgcuucugccugccacgacggaaucaacuggcugacaauuggcaucagcgggccugauaauggagcuguggccguccugaaguauaacggcaucauuaccgacacaaucaaguccuggagaaauaacauucuccggacccaagagagcgagugugcgugcgugaaugggucuuguuucacggugaugacagauggaccguccgacggccaggccagcuacaaaaucuuucgcauugaaaagggcaaaaucgucaagucuguugagaugaacgcucccaauuaucauuacgaagagugcagcuguuacccugauuccucugagauuaccugcgugugcagagacaacuggcacgggagcaaucggcccuggguguccuucaaccagaaucuggaauaucagaucggauacaucuguagcggcauuuuuggggauaacccucgccccaaugacaaaacaggaucuugcggcccggucuccagcaacggggccaacggagugaagggcuucucuuuuaaguauggcaaugggguuuggaucggaagaaccaaauccauuagcucccggaacggcuucgagaugaucugggauccuaauggguggaccggaacagacaacaauuuuucuauuaagcaagacaucgugggcaucaacgaauggagcggguacuccggcucuuucguccagcaucccgagcuuacgggacuggauuguauucgcccuugcuucuggguggaacucaucagaggccggcccaaagagaauaccauuuggacaagcggguccagcaucucuuuuuguggaguuaacuccgacaccgugggcuggagcuggcccgauggggcugagcugccuuucacaauugacaaguga

SEQ ID NO: 201805 - RNA, 1410 nt, Artificial Sequence; identical to SEQ ID NO: 201804
  derived and/or modified sequence opt5 from neuraminidase__InfluenzaA__ADG58932

SEQ ID NO: 201806 - RNA, 1410 nt, Artificial Sequence; identical to SEQ ID NO: 201804
  derived and/or modified sequence opt5 from neuraminidase__InfluenzaA__ADG58933

SEQ ID NO: 201807 - RNA, 1410 nt, Artificial Sequence; identical to SEQ ID NO: 201804
  derived and/or modified sequence opt5 from neuraminidase__InfluenzaA__ADG58934

SEQ ID NO: 201808 - RNA, 1410 nt, Artificial Sequence; identical to SEQ ID NO: 201804
  derived and/or modified sequence opt5 from neuraminidase__InfluenzaA__ADG58935

SEQ ID NO: 201809 - RNA, 1410 nt, Artificial Sequence; identical to SEQ ID NO: 201804
  derived and/or modified sequence opt5 from neuraminidase__InfluenzaA__ADG58936

SEQ ID NO: 201810 - RNA, 1410 nt, Artificial Sequence; identical to SEQ ID NO: 201804
  derived and/or modified sequence opt5 from neuraminidase__InfluenzaA__ADG58937

SEQ ID NO: 201811 - RNA, 1410 nt, Artificial Sequence; identical to SEQ ID NO: 201804
  derived and/or modified sequence opt5 from neuraminidase__InfluenzaA__ADG58938

SEQ ID NO: 201812 - RNA, 1410 nt, Artificial Sequence
  derived and/or modified sequence opt5 from neuraminidase__InfluenzaA__ADG59589
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuauggccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaguggucaagagcguugagaugaaugcucccaacuaucauuacgaagagugcuccuguuacccugauucuagcgagaucacaugcgugugcagagacaauuggcacggguccaaccggcccugggugagcuucaaucagaaccuggaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 201813 - RNA, 1410 nt, Artificial Sequence; identical to SEQ ID NO: 199762
  derived and/or modified sequence opt5 from neuraminidase__InfluenzaA__ADG59590

SEQ ID NO: 201814 - RNA, 1410 nt, Artificial Sequence; identical to SEQ ID NO: 199762
  derived and/or modified sequence opt5 from neuraminidase__InfluenzaA__ADG59591

SEQ ID NO: 201815 - RNA, 1410 nt, Artificial Sequence; identical to SEQ ID NO: 199762
  derived and/or modified sequence opt5 from neuraminidase__InfluenzaA__ADG59592

SEQ ID NO: 201816 - RNA, 1410 nt, Artificial Sequence; identical to SEQ ID NO: 201664
  derived and/or modified sequence opt5 from neuraminidase__InfluenzaA__ADG59593

SEQ ID NO: 201817 - RNA, 1410 nt, Artificial Sequence; identical to SEQ ID NO: 200939
  derived and/or modified sequence opt5 from neuraminidase__InfluenzaA__ADG59594

SEQ ID NO: 201818 - RNA, 1410 nt, Artificial Sequence; identical to SEQ ID NO: 200939
  derived and/or modified sequence opt5 from neuraminidase__InfluenzaA__ADG59595

SEQ ID NO: 201819 - RNA, 1410 nt, Artificial Sequence
  derived and/or modified sequence opt5 from neuraminidase__InfluenzaA__ADG59596
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacagaaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 201820 - RNA, 1410 nt, Artificial Sequence; identical to SEQ ID NO: 199762
  derived and/or modified sequence opt5 from neuraminidase__InfluenzaA__ADG59597

SEQ ID NO: 201821 - RNA, 1410 nt, Artificial Sequence; identical to SEQ ID NO: 199762
  derived and/or modified sequence opt5 from neuraminidase__InfluenzaA__ADG59598

SEQ ID NO: 201822 - RNA, 1410 nt, Artificial Sequence; identical to SEQ ID NO: 200937
  derived and/or modified sequence opt5 from neuraminidase__InfluenzaA__ADG59599

SEQ ID NO: 201823 - RNA, 1410 nt, Artificial Sequence; identical to SEQ ID NO: 199762
  derived and/or modified sequence opt5 from neuraminidase__InfluenzaA__ADG59601

SEQ ID NO: 201824 - RNA, 1410 nt, Artificial Sequence; identical to SEQ ID NO: 201664
  derived and/or modified sequence opt5 from neuraminidase__InfluenzaA__ADG59602

SEQ ID NO: 201825 - RNA, 1410 nt, Artificial Sequence; identical to SEQ ID NO: 201664
  derived and/or modified sequence opt5 from neuraminidase__InfluenzaA__ADG59603

SEQ ID NO: 201826 - RNA, 1410 nt, Artificial Sequence; identical to SEQ ID NO: 199762
  derived and/or modified sequence opt5 from neuraminidase__InfluenzaA__ADG59604

SEQ ID NO: 201827 - RNA, 1410 nt, Artificial Sequence; identical to SEQ ID NO: 199762
  derived and/or modified sequence opt5 from neuraminidase__InfluenzaA__ADG59605

SEQ ID NO: 201828 - RNA, 1410 nt, Artificial Sequence; identical to SEQ ID NO: 200780
  derived and/or modified sequence opt5 from neuraminidase__InfluenzaA__ADG59606

SEQ ID NO: 201829 - RNA, 1410 nt, Artificial Sequence; identical to SEQ ID NO: 199762
  derived and/or modified sequence opt5 from neuraminidase__InfluenzaA__ADG59607

SEQ ID NO: 201830 - RNA, 1410 nt, Artificial Sequence; identical to SEQ ID NO: 199762
  derived and/or modified sequence opt5 from neuraminidase__InfluenzaA__ADG59608

SEQ ID NO: 201831 - RNA, 1410 nt, Artificial Sequence; identical to SEQ ID NO: 200583
  derived and/or modified sequence opt5 from neuraminidase__InfluenzaA__ADG59609

SEQ ID NO: 201832 - RNA, 1410 nt, Artificial Sequence; identical to SEQ ID NO: 201664
  derived and/or modified sequence opt5 from neuraminidase__InfluenzaA__ADG59610

SEQ ID NO: 201833 - RNA, 1410 nt, Artificial Sequence; identical to SEQ ID NO: 200780
  derived and/or modified sequence opt5 from neuraminidase__InfluenzaA__ADG59611

SEQ ID NO: 201834 - RNA, 1410 nt, Artificial Sequence; identical to SEQ ID NO: 201664
  derived and/or modified sequence opt5 from neuraminidase__InfluenzaA__ADG59612

SEQ ID NO: 201835 - RNA, 1410 nt, Artificial Sequence
  derived and/or modified sequence opt5 from neuraminidase__InfluenzaA__ADG59613
augaaccccaaucagaagaucauuaccaucggcagcgugugcaugacaauugggaugacgaaccugauccuccaacugggaaauauuaucuccaucuggauuucucacagcauccagcuuggcaaccagaaucagauugagaccuguaaccaauccgucaucacauacgaaaauaacaccuggguuaaucagacauaugugaacauuucuaauaccaacuucgccgcugggcagagcguggucuccgugaaacuggccggaaauucuagccucugcccuguuuccggcugggcgaucuacagcaaggacaacucuauuagaaucggguccaaaggagauguguuugucauccgggagccguucauuagcuguucuccccuggaaugccgcacauuuuuccuuacccagggcgcucugcucaaugacaagcauuccaacggcacgaucaaagauagaagcccuuaucggacccugaugucuugucccauuggggaggugccuucccccuacaacagccgcuuugaauccguugccuggucugccagcgcuugccacgacggaaucaauuggcugacaauuggcaucuccgggccugauaacggagccguggcuguccucaaguauaauggcaucauuaccgacacaaucaagagcuggagaaacaauauucugcggacccaagagucugagugugccugcgugaacggguccuguuucacggugaugacagauggaccgagcgacggccaggcgucuuacaaaaucuuucgcauugaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuugaauaucagaucggauacaucuguucuggcauuuuuggggauaauccucgccccaacgacaaaacaggauccugcggcccggucagcucuaauggggcuaacggagugaagggcuucuccuuuaaguauggcaacgggguuuggaucggaagaaccaaaagcauuuccucucggaauggcuucgagaugaucugggauccuaacggguggaccggaacagacaauagcuuuuccauuaagcaagacaucgugggcaucaacgaauggucuggguacagcggcuccuucguccagcaucccgagcugacgggacucgauuguauucgcccuugcuucuggguggaacugaucagaggccggcccaaagagaauaccguuuggacaagcgggucuuccauuagcuuuuguggagugaacucugacaccgucggcugguccuggcccgauggggccgagcuuccuuucacaaucgacaaguga

SEQ ID NO: 201836 - RNA, 1410 nt, Artificial Sequence; identical to SEQ ID NO: 200937
  derived and/or modified sequence opt5 from neuraminidase__InfluenzaA__ADG59614

SEQ ID NO: 201837 - RNA, 1410 nt, Artificial Sequence; identical to SEQ ID NO: 199762
  derived and/or modified sequence opt5 from neuraminidase__InfluenzaA__ADH01811

SEQ ID NO: 201838 - RNA, 1410 nt, Artificial Sequence; identical to SEQ ID NO: 199762
  derived and/or modified sequence opt5 from neuraminidase__InfluenzaA__ADH01821

SEQ ID NO: 201839 - RNA, 1410 nt, Artificial Sequence; identical to SEQ ID NO: 199762
  derived and/or modified sequence opt5 from neuraminidase__InfluenzaA__ADH01831

SEQ ID NO: 201840 - RNA, 1410 nt, Artificial Sequence; identical to SEQ ID NO: 199762
  derived and/or modified sequence opt5 from neuraminidase__InfluenzaA__ADH01841

SEQ ID NO: 201841 - RNA, 1410 nt, Artificial Sequence; identical to SEQ ID NO: 199762
  derived and/or modified sequence opt5 from neuraminidase__InfluenzaA__ADH01851

SEQ ID NO: 201842 - RNA, 1410 nt, Artificial Sequence; identical to SEQ ID NO: 199762
  derived and/or modified sequence opt5 from neuraminidase__InfluenzaA__ADH01861

SEQ ID NO: 201843 - RNA, 1410 nt, Artificial Sequence; identical to SEQ ID NO: 199762
  derived and/or modified sequence opt5 from neuraminidase__InfluenzaA__ADH01871

SEQ ID NO: 201844 - RNA, 1410 nt, Artificial Sequence; identical to SEQ ID NO: 199762
  derived and/or modified sequence opt5 from neuraminidase__InfluenzaA__ADH01881

SEQ ID NO: 201845 - RNA, 1410 nt, Artificial Sequence; identical to SEQ ID NO: 199762
  derived and/or modified sequence opt5 from neuraminidase__InfluenzaA__ADH01891

SEQ ID NO: 201846 - RNA, 1410 nt, Artificial Sequence; identical to SEQ ID NO: 199762
  derived and/or modified sequence opt5 from neuraminidase__InfluenzaA__ADH01901

SEQ ID NO: 201847 - RNA, 1410 nt, Artificial Sequence; identical to SEQ ID NO: 199762
  derived and/or modified sequence opt5 from neuraminidase__InfluenzaA__ADH01911

SEQ ID NO: 201848 - RNA, 1410 nt, Artificial Sequence; identical to SEQ ID NO: 199762
  derived and/or modified sequence opt5 from neuraminidase__InfluenzaA__ADH01921

SEQ ID NO: 201849 - RNA, 1410 nt, Artificial Sequence; identical to SEQ ID NO: 199762
  derived and/or modified sequence opt5 from neuraminidase__InfluenzaA__ADH01931

SEQ ID NO: 201850 - RNA, 1410 nt, Artificial Sequence; identical to SEQ ID NO: 201653
  derived and/or modified sequence opt5 from neuraminidase__InfluenzaA__ADH01941

SEQ ID NO: 201851 - RNA, 1410 nt, Artificial Sequence; identical to SEQ ID NO: 199762
  derived and/or modified sequence opt5 from neuraminidase__InfluenzaA__ADH01951

SEQ ID NO: 201852 - RNA, 1410 nt, Artificial Sequence; identical to SEQ ID NO: 199762
  derived and/or modified sequence opt5 from neuraminidase__InfluenzaA__ADH01961

SEQ ID NO: 201853 - RNA, 1410 nt, Artificial Sequence
  derived and/or modified sequence opt5 from neuraminidase__InfluenzaA__ADH01981
augaaccccaaucagaagaucauuaccaucggcagcgccugcaugacaauugggauggcuaaccugauccuccaaauuggaaauaucaucuccauuuggaucucucacagcauucagcugggcaaccagaaucagacggagaccuguaaccaauccgugaucacauacgaaaauaacaccugggucaaucagacauauguuaacauuucuaauaccaacuucgccgcggggcagagcgugguguccgucaaacuugcuggaaauucuagccugugcccuguguccggcugggccaucuacagcaaggacaacucuauuagaaucggguccaaaggagauguuuuugugauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggucccuucccccuacaacagccgcuuugaauccguggcuuggucugccagcgcuugccacgacggaaucaauuggcugacaauuggcaucuccgggccugauaacggagccguugcggugcugaaguauaauggcaucauuaccgacacaaucaagagcuggagaaacaauauucuccggacccaagagucugagugugccugcgucaacggguccuguuucacggugaugacagauggaccgagcgacggccaggcuucuuacaaaaucuuucgcauugaaaagggcaaaaucgucaagagcguggagaugaaugcccccaacuaucauuacgaagagugcuccuguuacccugauucuagcgagauuaccugcguuugcagagacaauuggcacggguccaaccggcccugggugagcuucaaucagaaccuggaauaucagaucggauacaucuguucuggcauuuuuggggauaauccucgccccaacgacaaaacaggauccugcggcccggugagcucuaauggggcuaacggagucaagggcuucuccuuuaaguauggcaacgggguguggaucggaagaaccaaaagcauuuccucucggaauggcuucgagaugaucugggauccuaacggguggaccggaacagacaauaacuuuagcauuaagcaagacaucguuggcaucaaugaaugguccggguacucuggcagcuucgugcagcaucccgagcuuacgggacuggauuguauucgcccuugcuucugggucgaacucaucagaggccggcccaaagagaacaccauuuggacauccgggagcucuaucuccuuuuguggagugaauagcgacaccguuggcuggucuuggcccgauggggccgagcugccuuucacaauugacaaguga

SEQ ID NO: 201854 - RNA, 1410 nt, Artificial Sequence; identical to SEQ ID NO: 201050
  derived and/or modified sequence opt5 from neuraminidase__InfluenzaA__ADH01991

SEQ ID NO: 201855 - RNA, 1410 nt, Artificial Sequence; identical to SEQ ID NO: 201719
  derived and/or modified sequence opt5 from neuraminidase__InfluenzaA__ADH02011

SEQ ID NO: 201856 - RNA, 1410 nt, Artificial Sequence; identical to SEQ ID NO: 200939
  derived and/or modified sequence opt5 from neuraminidase__InfluenzaA__ADH02021

SEQ ID NO: 201857 - RNA, 1410 nt, Artificial Sequence; identical to SEQ ID NO: 199762
  derived and/or modified sequence opt5 from neuraminidase__InfluenzaA__ADI24510

SEQ ID NO: 201858 - RNA, 1410 nt, Artificial Sequence; identical to SEQ ID NO: 199762
  derived and/or modified sequence opt5 from neuraminidase__InfluenzaA__ADI24516

SEQ ID NO: 201859 - RNA, 1410 nt, Artificial Sequence; identical to SEQ ID NO: 199762
  derived and/or modified sequence opt5 from neuraminidase__InfluenzaA__ADI24518

SEQ ID NO: 201860 - RNA, 1410 nt, Artificial Sequence; identical to SEQ ID NO: 199762
  derived and/or modified sequence opt5 from neuraminidase__InfluenzaA__ADI24522

SEQ ID NO: 201861 - RNA, 1410 nt, Artificial Sequence; identical to SEQ ID NO: 199762
  derived and/or modified sequence opt5 from neuraminidase__InfluenzaA__ADI24524

SEQ ID NO: 201862 - RNA, 1410 nt, Artificial Sequence; identical to SEQ ID NO: 199762
  derived and/or modified sequence opt5 from neuraminidase__InfluenzaA__ADI24526

SEQ ID NO: 201863 - RNA, 1410 nt, Artificial Sequence; identical to SEQ ID NO: 199762
  derived and/or modified sequence opt5 from neuraminidase__InfluenzaA__ADI24528

SEQ ID NO: 201864 - RNA, 1410 nt, Artificial Sequence; identical to SEQ ID NO: 199762
  derived and/or modified sequence opt5 from neuraminidase__InfluenzaA__ADI24530

SEQ ID NO: 201865 - RNA, 1410 nt, Artificial Sequence
  derived and/or modified sequence opt5 from neuraminidase__InfluenzaA__ADI24532
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucucuagcuccggggccaauggagugaagggcuucagcuuuaaguauggcaacgggguuuggauuggaagaacaaaauccaucucuagccggaacggcuucgagaugauuugggauccuaauggguggaccggaaccgacaacaauuuuuccaucaagcaagacaucgugggcauuaacgaauggucuggguacagcggcuccuucguccagcaucccgagcuuacaggacuggauuguauccgcccuugcuucuggguggaacucauuagaggccggcccaaagagaauacgaucuggaccagcgggucuuccauuagcuuuuguggaguuaacucugacacagugggcugguccuggcccgauggggcugagcugccuuucaccaucgacaaguga

SEQ ID NO: 201866 - RNA, 1410 nt, Artificial Sequence; identical to SEQ ID NO: 199762
  derived and/or modified sequence opt5 from neuraminidase__InfluenzaA__ADI24538

SEQ ID NO: 201867 - RNA, 1410 nt, Artificial Sequence; identical to SEQ ID NO: 199762
  derived and/or modified sequence opt5 from neuraminidase__InfluenzaA__ADI24548

SEQ ID NO: 201868 - RNA, 1410 nt, Artificial Sequence; identical to SEQ ID NO: 199762
  derived and/or modified sequence opt5 from neuraminidase__InfluenzaA__ADI24556

SEQ ID NO: 201869 - RNA, 1410 nt, Artificial Sequence; identical to SEQ ID NO: 199762
  derived and/or modified sequence opt5 from neuraminidase__InfluenzaA__ADI24558

SEQ ID NO: 201870 - RNA, 1410 nt, Artificial Sequence; identical to SEQ ID NO: 199762
  derived and/or modified sequence opt5 from neuraminidase__InfluenzaA__ADI24560

SEQ ID NO: 201871 - RNA, 1410 nt, Artificial Sequence; identical to SEQ ID NO: 199762
  derived and/or modified sequence opt5 from neuraminidase__InfluenzaA__ADI24562

SEQ ID NO: 201872 - RNA, 1410 nt, Artificial Sequence; identical to SEQ ID NO: 199762
  derived and/or modified sequence opt5 from neuraminidase__InfluenzaA__ADI24564

SEQ ID NO: 201873 - RNA, 1410 nt, Artificial Sequence; identical to SEQ ID NO: 199762
  derived and/or modified sequence opt5 from neuraminidase__InfluenzaA__ADI24566

SEQ ID NO: 201874 - RNA, 1410 nt, Artificial Sequence; identical to SEQ ID NO: 199762
  derived and/or modified sequence opt5 from neuraminidase__InfluenzaA__ADI24568

SEQ ID NO: 201875 - RNA, 1410 nt, Artificial Sequence; identical to SEQ ID NO: 199762
  derived and/or modified sequence opt5 from neuraminidase__InfluenzaA__ADI24570

SEQ ID NO: 201876 - RNA, 1410 nt, Artificial Sequence; identical to SEQ ID NO: 199762
  derived and/or modified sequence opt5 from neuraminidase__InfluenzaA__ADI24572

SEQ ID NO: 201877 - RNA, 1410 nt, Artificial Sequence; identical to SEQ ID NO: 199762
  derived and/or modified sequence opt5 from neuraminidase__InfluenzaA__ADI24574

SEQ ID NO: 201878 - RNA, 1410 nt, Artificial Sequence; identical to SEQ ID NO: 199762
  derived and/or modified sequence opt5 from neuraminidase__InfluenzaA__ADI24576

SEQ ID NO: 201879 - RNA, 1410 nt, Artificial Sequence; identical to SEQ ID NO: 199762
  derived and/or modified sequence opt5 from neuraminidase__InfluenzaA__ADI24580

SEQ ID NO: 201880 - RNA, 1410 nt, Artificial Sequence; identical to SEQ ID NO: 200937
  derived and/or modified sequence opt5 from neuraminidase__InfluenzaA__ADI24582

SEQ ID NO: 201881 - RNA, 1410 nt, Artificial Sequence
  derived and/or modified sequence opt5 from neuraminidase__InfluenzaA__ADI24584
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucccugugaaacuugcgggaaauuccucucugugcccgguuaacggcugggcuauuuacagcaaggacaauuccaucagaaucgggagcaaaggagauguguuugucauucgggagcccuucaucucuuguuccccucucgaaugccgcaccuuuuuccugacacagggcgcccuucugaacgacaagcauagcaacggcaccauuaaagauagaucucccuaucggacgcucauguccuguccuaucggggaggugcccagcccuuacaauucucgcuuugaauccguugccuggagcgcuuccgccugccacgacggaauuaacuggcugaccaucggcaucucugggccggauaauggagcuguggccguccugaaguauaacggcauuaucacagacaccauuaagagcuggagaaauaacauccuccggacacaagaguccgagugugcgugcgugaaugggagcuguuucaccgugaugacggauggacccucugacggccaggccuccuacaaaauuuuucgcaucgaaaagggcaaaaucgucaagagcguugagaugaacgcuccuaauuaucauuacgaagagugcucuuguuaccccgauagcuccgagauuacaugcgugugcagagacaacuggcacgggucuaaucggccuugggugagcuucaaccagaaucuggaauaucagaucggauacauuuguuccggcaucuuuggggauaacccccgcccgaaugacaaaaccggaagcugcggcccugucucuuccaacggggccaacggagugaagggcuucagcuuuaaguauggcaaugggguuuggauuggaagaacaaaaucuaucuccagccggaacggcuucgagaugauuugggaucccaauggguggaccggaaccgacaacaauuuuuccaucaagcaagacaucgugggcauuaacgaauggucuggguacagcggcuccuucguccagcauccugagcuuacaggacuggauuguauccgccccugcuucuggguggaacucauuagaggccggcccaaagagaauacgaucuggaccucugggagcuccauuagcuuuuguggaguuaacucugacacagugggcugguccuggccugauggggcugagcugccguucaccaucgacaaguga

SEQ ID NO: 201882 - RNA, 1410 nt, Artificial Sequence; identical to SEQ ID NO: 200116
  derived and/or modified sequence opt5 from neuraminidase__InfluenzaA__ADI24592

SEQ ID NO: 201883 - RNA, 1410 nt, Artificial Sequence; identical to SEQ ID NO: 199762
  derived and/or modified sequence opt5 from neuraminidase__InfluenzaA__ADI24598

SEQ ID NO: 201884 - RNA, 1410 nt, Artificial Sequence; identical to SEQ ID NO: 199762
  derived and/or modified sequence opt5 from neuraminidase__InfluenzaA__ADI24604

SEQ ID NO: 201885 - RNA, 1410 nt, Artificial Sequence; identical to SEQ ID NO: 199762
  derived and/or modified sequence opt5 from neuraminidase__InfluenzaA__ADI24620

SEQ ID NO: 201886 - RNA, 1410 nt, Artificial Sequence; identical to SEQ ID NO: 199762
  derived and/or modified sequence opt5 from neuraminidase__InfluenzaA__ADI24622

SEQ ID NO: 201887 - RNA, 1410 nt, Artificial Sequence; identical to SEQ ID NO: 200116
  derived and/or modified sequence opt5 from neuraminidase__InfluenzaA__ADI46780

SEQ ID NO: 201888 - RNA, 1410 nt, Artificial Sequence
  derived and/or modified sequence opt5 from neuraminidase__InfluenzaA__ADI46789
augaaccccaaucagaagaucauuaccaucggcagcgugugcaugacaauugggauggccaaccugaugcuccaaaucggaaauauuaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucugugagaauuggguccaaaggagaugucuuugugauccgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggccuggucugcuagcgccugccacgacggaauuaauuggcugaccaucggcauuuccgggccugauaacggagcugucgccgugcugaaguauaauggcaucaucacagacaccauuaagagcuggagaaacaauauccuccggacacaagagucugagugugcgugcgugaacggguccuguuucaccgucaugacggauggaccgagcaaugaacaggccucuuacaaaauuuuucgcaucgagaagggcaaaauuguuaagagcguggaaaugaacgcucccaauuaucauuacgaggagugcuccuguuacccugacucuagcgaaaucacaugcgugugcagagauaacuggcacggcuccaaucggcccugggucagcuucaaccagaaucuggaguaucagaucggguacauuuguucuggaaucuuuggcgacaacccucgccccaaugauaaaaccggguccugcggaccggugagcucuaacggcgccaacgggguuaagggauucuccuuuaaguauggcaauggcguguggauugggagaacaaaaagcaucuccucucggaacggauucgaaaugauuugggacccuaauggcuggaccgggaccgauaacaauuuuagcaucaagcaagacauugucggaaucaacgagugguccggcuacucugggagcuucgugcagcaucccgaacuuacaggccuggacuguauccgcccuugcuucuggguugagcucauuagaggacggcccaaagagaauacgaucuggaccuccggcagcucuauuuccuuuuguggggugaacagcgauacagucggauggucuuggcccgacggcgcugaacugccuuucaccaucgauaaguga

SEQ ID NO: 201889 - RNA, 1410 nt, Artificial Sequence; identical to SEQ ID NO: 199762
  derived and/or modified sequence opt5 from neuraminidase__InfluenzaA__ADI48185

SEQ ID NO: 201890 - RNA, 1410 nt, Artificial Sequence; identical to SEQ ID NO: 199762
  derived and/or modified sequence opt5 from neuraminidase__InfluenzaA__ADI48187

SEQ ID NO: 201891 - RNA, 1410 nt, Artificial Sequence; identical to SEQ ID NO: 199762
  derived and/or modified sequence opt5 from neuraminidase__InfluenzaA__ADI48189

SEQ ID NO: 201892 - RNA, 1410 nt, Artificial Sequence; identical to SEQ ID NO: 199762
  derived and/or modified sequence opt5 from neuraminidase__InfluenzaA__ADI48191

SEQ ID NO: 201893 - RNA, 1410 nt, Artificial Sequence; identical to SEQ ID NO: 199762
  derived and/or modified sequence opt5 from neuraminidase__InfluenzaA__ADI48193

SEQ ID NO: 201894 - RNA, 1410 nt, Artificial Sequence; identical to SEQ ID NO: 199762
  derived and/or modified sequence opt5 from neuraminidase__InfluenzaA__ADI48195

SEQ ID NO: 201895 - RNA, 1410 nt, Artificial Sequence
  derived and/or modified sequence opt5 from neuraminidase__InfluenzaA__ADI48197
augaaccccaaucagaagaucauuaccaucggcagcgugugcaugacaauugggauggccaaccugauccuccaaauuggaaauaucaucuccauuuggaucucucacagcauucaguucggcaaccagaaucagaucgagacguguaaccaauccgucauuaccuacgaaaauaacacauggguuaaucagaccuaugugaacaucucuaauacaaacuuugcugccgggcagagcguggucuccgugaaacuggcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagagaacacgaucuggaccuccgggagcucuauuuccuucuguggaguuaauagcgacacagugggcuggucuuggcccgauggggcugagcucccuuuuaccaucgacaaguga

SEQ ID NO: 201896 - RNA, 1410 nt, Artificial Sequence; identical to SEQ ID NO: 199762
  derived and/or modified sequence opt5 from neuraminidase__InfluenzaA__ADI48199

SEQ ID NO: 201897 - RNA, 1410 nt, Artificial Sequence; identical to SEQ ID NO: 199762
  derived and/or modified sequence opt5 from neuraminidase__InfluenzaA__ADI48201

SEQ ID NO: 201898 - RNA, 1410 nt, Artificial Sequence; identical to SEQ ID NO: 199762
  derived and/or modified sequence opt5 from neuraminidase__InfluenzaA__ADI48203

SEQ ID NO: 201899 - RNA, 1410 nt, Artificial Sequence
  derived and/or modified sequence opt5 from neuraminidase__InfluenzaA__ADI48205
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucucaucucgaaugccgcaccuuuuuccugacacagggcgcccuucugaaugacaagcacuccaacggcaccauuaaagauagaagccccuaucggacgcucaugucuuguccuaucggggaggugcccuccccuuacaacagccgcuuugaauccguugccuggucugcuagcgccugccaugacggaauuaauuggcugaccaucggcaucuccgggcccgauaacggagcuguggccguccugaaguauaauggcauuaucacagacaccauuaagagcuggagaaacaauauccuccggacacaagagucugagugugcgugcgugaacggguccuguuucaccgugaugacggauggaccuagcgacggccaggccucuuacaaaauuuuucgcaucgaaaagggcaaaaucgucaagagcguugagaugaaugcuccgaacuaucacuacgaagagugcuccuguuaccccgauucuagcgagauuacaugcgugugcagagacaauuggcauggguccaaccggccuugggugagcuucaaucagaaccuggaauaucagaucggauacauuuguucuggcaucuuuggggauaauccccgcccuaacgacaaaaccggauccugcggccccgucagcucuaauggggccaacggagugaagggcuucuccuuuaaguauggcaacgggguuuggauuggaagaacaaaaagcaucuccucucggaauggcuucgagaugauuugggauccgaacggguggaccggaaccgacaauaacuuuagcaucaagcaagacaucgugggcauuaaugaaugguccggguacucuggcagcuucguccagcacccugagcuuacaggacuggauuguauccgccccugcuucuggguggaacucauuagaggccggccuaaagagaacacgaucuggaccuccgggagcucuauuuccuuuuguggaguuaauagcgacacagugggcuggucuuggcccgauggggcugagcugcccuucaccaucgacaaguga

SEQ ID NO: 201900 - RNA, 1410 nt, Artificial Sequence; identical to SEQ ID NO: 199762
  derived and/or modified sequence opt5 from neuraminidase__InfluenzaA__ADI48207

SEQ ID NO: 201901 - RNA, 1410 nt, Artificial Sequence; identical to SEQ ID NO: 199762
  derived and/or modified sequence opt5 from neuraminidase__InfluenzaA__ADI48209

SEQ ID NO: 201902 - RNA, 1410 nt, Artificial Sequence; identical to SEQ ID NO: 199762
  derived and/or modified sequence opt5 from neuraminidase__InfluenzaA__ADI48211

SEQ ID NO: 201903 - RNA, 1410 nt, Artificial Sequence; identical to SEQ ID NO: 199762
  derived and/or modified sequence opt5 from neuraminidase__InfluenzaA__ADI48213

SEQ ID NO: 201904 - RNA, 1410 nt, Artificial Sequence; identical to SEQ ID NO: 199762
  derived and/or modified sequence opt5 from neuraminidase__InfluenzaA__ADI48215

SEQ ID NO: 201905 - RNA, 1410 nt, Artificial Sequence; identical to SEQ ID NO: 199762
  derived and/or modified sequence opt5 from neuraminidase__InfluenzaA__ADI48217

SEQ ID NO: 201906 - RNA, 1410 nt, Artificial Sequence; identical to SEQ ID NO: 199762
  derived and/or modified sequence opt5 from neuraminidase__InfluenzaA__ADI48219

SEQ ID NO: 201907 - RNA, 1410 nt, Artificial Sequence; identical to SEQ ID NO: 199762
  derived and/or modified sequence opt5 from neuraminidase__InfluenzaA__ADI48221

SEQ ID NO: 201908 - RNA, 1410 nt, Artificial Sequence; identical to SEQ ID NO: 199762
  derived and/or modified sequence opt5 from neuraminidase__InfluenzaA__ADI48625

SEQ ID NO: 201909 - RNA, 1410 nt, Artificial Sequence; identical to SEQ ID NO: 199762
  derived and/or modified sequence opt5 from neuraminidase__InfluenzaA__ADI48635

SEQ ID NO: 201910 - RNA, 1410 nt, Artificial Sequence; identical to SEQ ID NO: 199762
  derived and/or modified sequence opt5 from neuraminidase__InfluenzaA__ADI48655

SEQ ID NO: 201911 - RNA, 1410 nt, Artificial Sequence; identical to SEQ ID NO: 199762
  derived and/or modified sequence opt5 from neuraminidase__InfluenzaA__ADI48665

SEQ ID NO: 201912 - RNA, 1410 nt, Artificial Sequence
  derived and/or modified sequence opt5 from neuraminidase__InfluenzaA__ADI48675
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcugaaagagaacacgaucuggaccuccgggagcucuauuuccuuuuguggaguuaauagcgacacagugggcuggucuuggcccgauggggcugagcuucccuucaccaucgacaaguga

SEQ ID NO: 201913 - RNA, 1410 nt, Artificial Sequence
  derived and/or modified sequence opt5 from neuraminidase__InfluenzaA__ADI48685
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggggccuguuucaccgugaugacggauggaccguccgacggccaggcuagcuacaaaauuuuucgcaucgaaaagggcaaaaucgucaagucuguugagaugaaugcccccaacuaucauuacgaagagugcagcuguuacccugauuccucugagauuacaugcgugugcagagacaauuggcacgggagcaaccggcccuggguguccuucaaucagaaccuggaauaucagaucggauacauuuguagcggcaucuuuggggauaauccucgccccaacgacaaaaccggaucuugcggcccggucuccagcaauggggcuaacggagugaagggcuucucuuuuaaguauggcaacgggguuuggauuggaagaacaaaauccaucagcucccggaauggcuucgagaugauuugggauccuaacggguggaccggaaccgacaauaacuuuucuaucaagcaagacaucgugggcauuaaugaauggagcggguacuccggcucuuucguccagcaucccgagcuuacaggacuggauuguauccgcccuugcuucuggguggaacucauuagaggccggcccaaagagaacacgaucuggaccagcggguccagcauuucuuuuuguggaguuaauuccgacacagugggcuggagcuggcccgauggggccgagcugccuuucaccaucgacaaguga

SEQ ID NO: 201914 - RNA, 1410 nt, Artificial Sequence; identical to SEQ ID NO: 199762
  derived and/or modified sequence opt5 from neuraminidase__InfluenzaA__ADI48695

SEQ ID NO: 201915 - RNA, 1410 nt, Artificial Sequence; identical to SEQ ID NO: 199752
  derived and/or modified sequence opt5 from neuraminidase__InfluenzaA__ADI48705

SEQ ID NO: 201916 - RNA, 1410 nt, Artificial Sequence; identical to SEQ ID NO: 199762
  derived and/or modified sequence opt5 from neuraminidase__InfluenzaA__ADI48715

SEQ ID NO: 201917 - RNA, 1410 nt, Artificial Sequence; identical to SEQ ID NO: 199762
  derived and/or modified sequence opt5 from neuraminidase__InfluenzaA__ADI48725

SEQ ID NO: 201918 - RNA, 1410 nt, Artificial Sequence; identical to SEQ ID NO: 199762
  derived and/or modified sequence opt5 from neuraminidase__InfluenzaA__ADI48735

SEQ ID NO: 201919 - RNA, 1410 nt, Artificial Sequence; identical to SEQ ID NO: 199762
  derived and/or modified sequence opt5 from neuraminidase__InfluenzaA__ADI48745

SEQ ID NO: 201920 - RNA, 1410 nt, Artificial Sequence
  derived and/or modified sequence opt5 from neuraminidase__InfluenzaA__ADI48755
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucagcgacacaauuaagucuuggagaaacaauauccuccggacccaagaguccgagugugcgugcgugaacgggagcuguuucacagugaugaccgauggaccgucugacggccaggccagcuacaaaauuuuucgcaucgaaaagggcaaaaucgucaaguccguugagaugaaugcucccaacuaucauuacgaagagugcucuuguuacccugauagcuccgagauuacgugcgugugcagagacaauuggcacgggagcaaccggcccugggugucuuucaaucagaaccuggaauaucagaucggauacauuuguuccggcaucuuuggggauaauccucgccccaacgacaaaacaggaagcugcggcccggucucuuccaauggggccaacggagugaagggcuucagcuuuaaguauggcaacgggguuuggauuggaagaaccaaauccaucucuagccggaauggcuucgagaugauuugggauccuaacggguggacaggaaccgacaauaacuuuuccaucaagcaagacaucgugggcauuaaugaauggucuggguacagcggcuccuucguccagcaucccgagcuuaccggacuggauuguauccgcccuugcuucuggguggaacucauuagaggccggcccaaagagaacacaaucuggacgagcgggucuuccauuagcuuuuguggaguuaauucugacaccgugggcugguccuggcccgauggggcugagcugccuuucacaaucgacaaguga

SEQ ID NO: 201921 - RNA, 1410 nt, Artificial Sequence; identical to SEQ ID NO: 199762
  derived and/or modified sequence opt5 from neuraminidase__InfluenzaA__ADI48765

SEQ ID NO: 201922 - RNA, 1410 nt, Artificial Sequence; identical to SEQ ID NO: 199762
  derived and/or modified sequence opt5 from neuraminidase__InfluenzaA__ADI48775

SEQ ID NO: 201923 - RNA, 1410 nt, Artificial Sequence; identical to SEQ ID NO: 199762
  derived and/or modified sequence opt5 from neuraminidase__InfluenzaA__ADI48785

SEQ ID NO: 201924 - RNA, 1410 nt, Artificial Sequence; identical to SEQ ID NO: 199762
  derived and/or modified sequence opt5 from neuraminidase__InfluenzaA__ADI48795

SEQ ID NO: 201925 - RNA, 1410 nt, Artificial Sequence; identical to SEQ ID NO: 199762
  derived and/or modified sequence opt5 from neuraminidase__InfluenzaA__ADI49032

SEQ ID NO: 201926 - RNA, 1410 nt, Artificial Sequence; identical to SEQ ID NO: 199762
  derived and/or modified sequence opt5 from neuraminidase__InfluenzaA__ADI49243

SEQ ID NO: 201927 - RNA, 1410 nt, Artificial Sequence; identical to SEQ ID NO: 199762
  derived and/or modified sequence opt5 from neuraminidase__InfluenzaA__ADI49263

SEQ ID NO: 201928 - RNA, 1410 nt, Artificial Sequence; identical to SEQ ID NO: 199762
  derived and/or modified sequence opt5 from neuraminidase__InfluenzaA__ADI49273

SEQ ID NO: 201929 - RNA, 1410 nt, Artificial Sequence; identical to SEQ ID NO: 199762
  derived and/or modified sequence opt5 from neuraminidase__InfluenzaA__ADI49283

SEQ ID NO: 201930 - RNA, 1410 nt, Artificial Sequence; identical to SEQ ID NO: 199762
  derived and/or modified sequence opt5 from neuraminidase__InfluenzaA__ADI49315

SEQ ID NO: 201931 - RNA, 1410 nt, Artificial Sequence; identical to SEQ ID NO: 199762
  derived and/or modified sequence opt5 from neuraminidase__InfluenzaA__ADI49325

SEQ ID NO: 201932 - RNA, 1410 nt, Artificial Sequence; identical to SEQ ID NO: 199762
  derived and/or modified sequence opt5 from neuraminidase__InfluenzaA__ADI49335

SEQ ID NO: 201933 - RNA, 1410 nt, Artificial Sequence
  derived and/or modified sequence opt5 from neuraminidase__InfluenzaA__ADI49345
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaaccuugcugccgggcagagcguggucuccgugaaacuggcgggaaauucuagccucugcccuguuuccggcugggcuauuuacagcaaggacaacucuaucagaaucggguccaaaggagauguguucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggacgugccuucccccuacaacagccgcuucgaguccguugccuggucugcuagcgccugccacgauggaauuaauuggcugaccaucggcaucuccgggccugacaacggagcuguggccguccucaaguauaauggcauuaucacagauaccauuaagagcuggagaaacaauauccugcggacacaagaaucugagugugcgugcgugaacggguccuguuuuaccgugaugacggacggaccgagcgauggccaggccucuuacaaaauuuuccgcaucgagaagggcaaaaucgucaagagcguugaaaugaaugcucccaacuaucauuacgaggaaugcuccuguuacccugacucuagcgagauuacaugcgugugcagagauaauuggcacggguccaaccggcccugggugagcuuuaaucagaaccuugaguaucagaucggauacauuuguucuggcaucuucggggacaauccucgccccaacgauaaaaccggauccugcggcccggucagcucuaauggggccaacggagugaagggcuuuuccuucaaguauggcaacgggguuuggauuggaagaacaaaaagcaucuccucucggaauggcuuugaaaugauuugggacccuaacggguggaccggaaccgacaauaacuucagcaucaagcaagauaucgugggcauuaaugagugguccggguacucuggcagcuuuguccagcaucccgaacugacaggacucgacuguauccgcccuugcuucuggguggagcugauuagaggccggcccaaagaaaacacgaucuggaccuccgggagcucuauuuccuucuguggaguuaauagcgauacagugggcuggucuuggcccgacggggcugagcuuccuuuuaccaucgauaaguga

SEQ ID NO: 201934 - RNA, 1410 nt, Artificial Sequence; identical to SEQ ID NO: 199762
  derived and/or modified sequence opt5 from neuraminidase__InfluenzaA__ADI49355

SEQ ID NO: 201935 - RNA, 1410 nt, Artificial Sequence; identical to SEQ ID NO: 199762
  derived and/or modified sequence opt5 from neuraminidase__InfluenzaA__ADI49365

SEQ ID NO: 201936 - RNA, 1410 nt, Artificial Sequence; identical to SEQ ID NO: 199762
  derived and/or modified sequence opt5 from neuraminidase__InfluenzaA__ADI49375

SEQ ID NO: 201937 - RNA, 1410 nt, Artificial Sequence; identical to SEQ ID NO: 199762
  derived and/or modified sequence opt5 from neuraminidase__InfluenzaA__ADI49385

SEQ ID NO: 201938 - RNA, 1410 nt, Artificial Sequence
  derived and/or modified sequence opt5 from neuraminidase__InfluenzaA__ADI49395
augaaccccaaucagaagaucauuaccaucggcagcgugugcaugacaauugggauggccaaccugauccuccaaauuggaaauaugaucuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucaauuggcugaccauuggcaucuccgggccugauaacggagcuguggccguccugaaguauaauggcaucauuacagacaccaucaagagcuggagaaacaauauucuccggacacaagagucugagugugcgugcgugaacggguccuguuucaccgugaugacggauggaccgagcgacggccaggccucuuacaaaaucuuucgcauugaaaagggcaaaaucgucaagagcguugagcugaaugcucccaacuaucauuacgaagagugcuccuguuacccugauucuagcgagaucacaugcgugugcagagacaauuggcacggguccaaccggcccugggugagcuucaaucagaaccuugaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 201939 - RNA, 1410 nt, Artificial Sequence; identical to SEQ ID NO: 199762
  derived and/or modified sequence opt5 from neuraminidase__InfluenzaA__ADI49720

SEQ ID NO: 201940 - RNA, 1410 nt, Artificial Sequence; identical to SEQ ID NO: 199762
  derived and/or modified sequence opt5 from neuraminidase__InfluenzaA__ADI49730

SEQ ID NO: 201941 - RNA, 1410 nt, Artificial Sequence; identical to SEQ ID NO: 199762
  derived and/or modified sequence opt5 from neuraminidase__InfluenzaA__ADI49740

SEQ ID NO: 201942 - RNA, 1410 nt, Artificial Sequence; identical to SEQ ID NO: 199762
  derived and/or modified sequence opt5 from neuraminidase__InfluenzaA__ADI49750

SEQ ID NO: 201943 - RNA, 1410 nt, Artificial Sequence; identical to SEQ ID NO: 199762
  derived and/or modified sequence opt5 from neuraminidase__InfluenzaA__ADI49760

SEQ ID NO: 201944 - RNA, 1410 nt, Artificial Sequence; identical to SEQ ID NO: 199792
  derived and/or modified sequence opt5 from neuraminidase__InfluenzaA__ADI49780

SEQ ID NO: 201945 - RNA, 1410 nt, Artificial Sequence; identical to SEQ ID NO: 199752
  derived and/or modified sequence opt5 from neuraminidase__InfluenzaA__ADI49790

SEQ ID NO: 201946 - RNA, 1410 nt, Artificial Sequence; identical to SEQ ID NO: 199762
  derived and/or modified sequence opt5 from neuraminidase__InfluenzaA__ADI49821

SEQ ID NO: 201947 - RNA, 1410 nt, Artificial Sequence; identical to SEQ ID NO: 199752
  derived and/or modified sequence opt5 from neuraminidase__InfluenzaA__ADI50029

SEQ ID NO: 201948 - RNA, 1410 nt, Artificial Sequence
  derived and/or modified sequence opt5 from neuraminidase__InfluenzaA__ADI52830
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucugugagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggacgagcugccuuucaccauugauaaguga

SEQ ID NO: 201949 - RNA, 1410 nt, Artificial Sequence
  derived and/or modified sequence opt5 from neuraminidase__InfluenzaA__ADI52831
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcguguccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 201950 - RNA, 1410 nt, Artificial Sequence; identical to SEQ ID NO: 199762
  derived and/or modified sequence opt5 from neuraminidase__InfluenzaA__ADI52832

SEQ ID NO: 201951 - RNA, 1410 nt, Artificial Sequence
  derived and/or modified sequence opt5 from neuraminidase__InfluenzaA__ADI52833
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggccccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 201952 - RNA, 1413 nt, Artificial Sequence; identical to SEQ ID NO: 200485
  derived and/or modified sequence opt5 from neuraminidase__InfluenzaA__ADI75821

SEQ ID NO: 201953 - RNA, 1410 nt, Artificial Sequence; identical to SEQ ID NO: 200929
  derived and/or modified sequence opt5 from neuraminidase__InfluenzaA__ADI75832

SEQ ID NO: 201954 - RNA, 1413 nt, Artificial Sequence
  derived and/or modified sequence opt5 from neuraminidase__InfluenzaA__ADI75854
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuaccguggauggcgccaauggggugaaaggauucagcuauaaguacggcaacggggucuggaucggacggacaaaaucuaaucgccugagaaagggcuuugagaugauuugggaccccaacggguggacgaauaccgacuccgauuucagcgugaaacaggacguuguggcgaucacagauugguccggcuauucuggaucuuuuguccagcacccggaacucaccggccuggacugcauccggccuuguuucuggguggagcuuguucgcgggcugcccagagaaaacacaaccauuuggacguccggaucuagcaucuccuucugcggcgugaacagcgauacagccaauuggucuuggccugacggggcugagcuccccuuuaccauugauaaguga

SEQ ID NO: 201955 - RNA, 1410 nt, Artificial Sequence
  derived and/or modified sequence opt5 from neuraminidase__InfluenzaA__ADI75876
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaagugugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuguggucuccagcuacguguguucuggacuuguuggcgacacgccccggaagaaugauagcuccucuagcucccauugccuggacccgaacaaugaggaaggcgggcacggagugaaaggcugggccuucgaugacgggaacgaugucuggaugggacgcaccaucagcgagaagucuagacucggcuaugagacauuuaaagugauugaagggugguccaaucauaagagcaaacugcagaucaaccggcaggucaucguggaccgcggaaauagaucuggcuacuccggcauuuucagcguugaggggaaguccuguaucaaccggugcuuuuauguggaacugauuagaggacgcaaggaggaaaccgagguccucuggaccucuaauagcaucgugguuuucuguggcacauccgggaccuacggaacaggcucuuggccugauggggcugaccugaaccuuaugcccauuuga

SEQ ID NO: 201956 - RNA, 1410 nt, Artificial Sequence; identical to SEQ ID NO: 200929
  derived and/or modified sequence opt5 from neuraminidase__InfluenzaA__ADI75887

SEQ ID NO: 201957 - RNA, 1413 nt, Artificial Sequence; identical to SEQ ID NO: 200485
  derived and/or modified sequence opt5 from neuraminidase__InfluenzaA__ADI75909

SEQ ID NO: 201958 - RNA, 1410 nt, Artificial Sequence; identical to SEQ ID NO: 201508
  derived and/or modified sequence opt5 from neuraminidase__InfluenzaA__ADI75920

SEQ ID NO: 201959 - RNA, 1413 nt, Artificial Sequence; identical to SEQ ID NO: 200485
  derived and/or modified sequence opt5 from neuraminidase__InfluenzaA__ADI77352

SEQ ID NO: 201960 - RNA, 1410 nt, Artificial Sequence; identical to SEQ ID NO: 199762
  derived and/or modified sequence opt5 from neuraminidase__InfluenzaA__ADI77363

SEQ ID NO: 201961 - RNA, 1410 nt, Artificial Sequence; identical to SEQ ID NO: 200939
  derived and/or modified sequence opt5 from neuraminidase__InfluenzaA__ADI99500

SEQ ID NO: 201962 - RNA, 1410 nt, Artificial Sequence
  derived and/or modified sequence opt5 from neuraminidase__InfluenzaA__ADI99553
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggacuccgucaaacuugcgggaaauucuagccugugcccuguguccggcugggcuauuuacagcaaggauaacucuaucagaaucggguccaaaggagacguuuuugugauucgggagccguucaucagcuguucuccccucgaaugccgcaccuuuuuccugacacagggcgcccuucugaaugauaagcauuccaacggcaccauuaaagacagaagcccuuaucggacgcucaugucuugucccaucggggaggucccuucccccuacaacagccgcuuugaauccguggccuggucugcuagcgccugccacgauggaauuaauuggcugaccaucggcaucuccgggccugacaacggagcuguugccgugcugaaguauaauggcauuaucacagauaccauuaagagcuggagaaacaauauccuccggacacaagagucugagugugcgugcgucaacggguccuguuucaccgugaugacggacggaccgagcgauggccaggccucuuacaaaauuuuucgcaucgaaaagggcaaaaucgucaagagcguggagaugaaugcucccaacuaucauuacgaagagugcuccuguuacccugacucuagcgagauuacaugcguuugcagagauaauuggcacggguccaaccggcccugggugagcuucaaucagaaccuggaauaucagaucggauacauuuguucuggcaucuuuggggacaauccucgccccaacgauaaaaccggauccugcggcccggugagcucuaauggggccaacggagucaagggcuucuccuuuaaguauggcaacgggguguggauuggaagaacaaaaagcaucuccucucggaauggcuucgagaugauuugggacccuaacggguggaccggaaccgacaauaacuuuagcaucaagcaagauaucguuggcauuaaugaaugguccggguacucuggcagcuucgugcagcaucccgagcuuacaggacuggacuguauccgcccuugcuucugggucgaacucauuagaggccggcccaaagagaacacgaucuggaccuccgggagcucuauuuccuuuuguggagugaauagcgauacaguuggcuggucuuggcccgacggggcugagcugccuuucaccaucgauaaguga

SEQ ID NO: 201963 - RNA, 1410 nt, Artificial Sequence
  derived and/or modified sequence opt5 from neuraminidase__InfluenzaA__ADI99563
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugaggugaaugcucccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggccaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggcugagcugccuuucaccaucgacaaguga

SEQ ID NO: 201964 - RNA, 1410 nt, Artificial Sequence; identical to SEQ ID NO: 201963
  derived and/or modified sequence opt5 from neuraminidase__InfluenzaA__ADI99573

SEQ ID NO: 201965 - RNA, 1410 nt, Artificial Sequence; identical to SEQ ID NO: 201963
  derived and/or modified sequence opt5 from neuraminidase__InfluenzaA__ADI99583

SEQ ID NO: 201966 - RNA, 1410 nt, Artificial Sequence; identical to SEQ ID NO: 201113
  derived and/or modified sequence opt5 from neuraminidase__InfluenzaA__ADI99593

SEQ ID NO: 201967 - RNA, 1410 nt, Artificial Sequence
  derived and/or modified sequence opt5 from neuraminidase__InfluenzaA__ADI99613
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcauuaucucuuuuuguggaguuaauuccgacacagugggcuggagcuggcccgauggggcugagcugccuuucaccaucgacaaguga

SEQ ID NO: 201968 - RNA, 1410 nt, Artificial Sequence
  derived and/or modified sequence opt5 from neuraminidase__InfluenzaA__ADI99623
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccaugaaacuugcgggaaauucuagccugugcccuguguccggcugggcuauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggccuggucugcuagcgccugccacgacggaauuaauuggcugaccaucggcaucuccgggccugauaacggagcuguugccgugcugaaguauaauggcauuaucacagacaccauuaagagcuggagaaacaauauccuccggacacaagagucugagugugcgugcgucaacggguccuguuucaccgugaugacggauggaccgagcgacggccaggccucuuacaaaauuuuucgcaucgaaaagggcaaaaucgucaagagcguggagaugaaugcucccaacuaucauuacgaagagugcuccuguuacccugauucuaaugagauuacaugcguuugcagagacaacuggcacgggagcaaucggcccuggguguccuucaaccagaaucuggaauaucagaucggauacauuuguagcggcaucuuuggggauaacccucgccccaaugacaaaaccggaucuugcggcccgguguccagcaacggggccaacggagucaagggcuucucuuuuaaguauggcaaugggguguggauuggaagaacaaaauccaucagcucccggaacggcuucgagaugauuugggauccuaauggguggaccggaaccgacaacaauuuuucuaucaagcaagacaucguuggcauuaacgaauggagcggguacuccggcucuuucgugcagcaucccgagcuuacaggacuggauuguauccgcccuugcuucugggucgaacucauuagaggccggcccaaagagaauacgaucuggaccagcggguccagcauuucuuuuuguggagugaacuccgacacaguuggcuggagcuggcccgauggggcugagcugccuuucaccaucgacaaguga

SEQ ID NO: 201969 - RNA, 1410 nt, Artificial Sequence; identical to SEQ ID NO: 201050
  derived and/or modified sequence opt5 from neuraminidase__InfluenzaA__ADI99633

SEQ ID NO: 201970 - RNA, 1410 nt, Artificial Sequence; identical to SEQ ID NO: 201113
  derived and/or modified sequence opt5 from neuraminidase__InfluenzaA__ADI99643

SEQ ID NO: 201971 - RNA, 1410 nt, Artificial Sequence; identical to SEQ ID NO: 199762
  derived and/or modified sequence opt5 from neuraminidase__InfluenzaA__ADI99653

SEQ ID NO: 201972 - RNA, 1410 nt, Artificial Sequence; identical to SEQ ID NO: 199762
  derived and/or modified sequence opt5 from neuraminidase__InfluenzaA__ADI99663

SEQ ID NO: 201973 - RNA, 1410 nt, Artificial Sequence; identical to SEQ ID NO: 199762
  derived and/or modified sequence opt5 from neuraminidase__InfluenzaA__ADI99673

SEQ ID NO: 201974 - RNA, 1410 nt, Artificial Sequence; identical to SEQ ID NO: 199762
  derived and/or modified sequence opt5 from neuraminidase__InfluenzaA__ADI99683

SEQ ID NO: 201975 - RNA, 1410 nt, Artificial Sequence; identical to SEQ ID NO: 201224
  derived and/or modified sequence opt5 from neuraminidase__InfluenzaA__ADI99703

SEQ ID NO: 201976 - RNA, 1410 nt, Artificial Sequence; identical to SEQ ID NO: 199762
  derived and/or modified sequence opt5 from neuraminidase__InfluenzaA__ADI99713

SEQ ID NO: 201977 - RNA, 1410 nt, Artificial Sequence; identical to SEQ ID NO: 199762
  derived and/or modified sequence opt5 from neuraminidase__InfluenzaA__ADI99723

SEQ ID NO: 201978 - RNA, 1410 nt, Artificial Sequence; identical to SEQ ID NO: 199762
  derived and/or modified sequence opt5 from neuraminidase__InfluenzaA__ADI99733

SEQ ID NO: 201979 - RNA, 1410 nt, Artificial Sequence; identical to SEQ ID NO: 199917
  derived and/or modified sequence opt5 from neuraminidase__InfluenzaA__ADJ00487

SEQ ID NO: 201980 - RNA, 1410 nt, Artificial Sequence; identical to SEQ ID NO: 199917
  derived and/or modified sequence opt5 from neuraminidase__InfluenzaA__ADJ00488

SEQ ID NO: 201981 - RNA, 1410 nt, Artificial Sequence; identical to SEQ ID NO: 199917
  derived and/or modified sequence opt5 from neuraminidase__InfluenzaA__ADJ00489

SEQ ID NO: 201982 - RNA, 1410 nt, Artificial Sequence; identical to SEQ ID NO: 199917
  derived and/or modified sequence opt5 from neuraminidase__InfluenzaA__ADJ00490

SEQ ID NO: 201983 - RNA, 1410 nt, Artificial Sequence; identical to SEQ ID NO: 199917
  derived and/or modified sequence opt5 from neuraminidase__InfluenzaA__ADJ00491

SEQ ID NO: 201984 - RNA, 1410 nt, Artificial Sequence; identical to SEQ ID NO: 199762
  derived and/or modified sequence opt5 from neuraminidase__InfluenzaA__ADJ18160

SEQ ID NO: 201985 - RNA, 1410 nt, Artificial Sequence; identical to SEQ ID NO: 199762
  derived and/or modified sequence opt5 from neuraminidase__InfluenzaA__ADJ18161

SEQ ID NO: 201986 - RNA, 1410 nt, Artificial Sequence
  derived and/or modified sequence opt5 from neuraminidase__InfluenzaA__ADJ18162
augauccccaaccagaagauuaucaccauuggcagcgugugcaugacaaucgggauggccaaucugauucuccaaaucggaaacaucauuuccaucuggauuucucacagcauccagcugggcaaucagaaccagauugagacguguaaucaauccgucaucaccuacgaaaacaauacauggguuaaccagaccuaugugaauauuucuaacacaaauuucgcugccgggcagagcguggucuccgugaaacuugcgggaaacucuagccugugcccuguuuccggcugggcuaucuacagcaaggacaauucuaucagaauuggguccaaaggagauguguuugucauccggaagccguucauuagcuguucuccccucgagugccgcaccuuuuuccugacacagggcgcccuucugaacgacaaacauuccaauggcaccaucaaggauagaagcccuuaucggacgcucaugucuugucccauuggggaagugccuucccccuacaacagccgcuuugaguccguugccuggucugcuagcgccugccacgacggaaucaacuggcugaccaucggcauuuccgggccugauaauggagcuguggccguccugaaguauaacggcaucauuacagacaccaucaaaagcuggagaaauaacauucuccggacacaagaaucugagugugcgugcgugaauggguccuguuucaccgugaugacggauggaccgagcgacggccaggccucuuacaagaucuuucgcaucgagaaaggcaagauugucaaaagcguugaaaugaacgcucccaauuaucauuacgaggaaugcuccuguuacccugauucuagcgagaucacaugcgugugcagagacaacuggcacggguccaaucggcccugggugagcuucaaccagaaucuggaguaucagauuggauacaucuguucuggcauuuuuggggauaacccucgccccaaugacaagaccggauccugcggcccggucagcucuaacggggccaauggagugaagggcuucuccuuuaaauauggcaacgggguuuggaucggaagaacaaagagcauuuccucucggaacggcuucgaaaugaucugggauccuaauggguggaccggaaccgacaacaauuuuagcaucaaacaagacauugugggcaucaacgagugguccggguacucuggcagcuucguccagcaucccgaacuuacaggacuggauuguauucgcccuugcuucuggguggagcucaucagaggccggcccaaggaaaauacgauuuggaccuccgggagcucuaucuccuuuuguggaguuaacagcgacacagugggcuggucuuggcccgauggggcugagcugccuuucaccaucgacaaauga

SEQ ID NO: 201987 - RNA, 1410 nt, Artificial Sequence
  derived and/or modified sequence opt5 from neuraminidase__InfluenzaA__ADJ18164
augaaccccaagcagaaaaucauuaccaucggcagcgugugcaugacaauugggauggccaaucugauccuccaaauuggaaacaucaucuccauuuggaucucucacagcauucagcugggcaaucagaaccagaucgagacguguaaucaauccgucauuaccuacgaaaacaauacauggguuaaccagaccuaugugaauaucucuaacacaaauuucgcugccgggcagagcguggucuccgugaaacuugcgggaaacucuagccugugcuccguuagcggcugggcuauuuacucuaaggacaauuccaucagaaucgggagcaagggagauguguuugucauucgggagccuuucaucucuuguuccccgcucgaaugccgcaccuuuuuccugacacagggcgcccuucugaacgacaaacauagcaauggcaccauuaaggauagaucucccuaucggacgcucauguccuguccuaucggggaggugcccagcccuuacaacucccgcuuugaaucuguugccuggagcgcuuccgccugccacgacggaauuaacuggcugaccaucggcaucagcgggcccgauaauggagcuguggccguccugaaguauaacggcauuaucacagacaccauuaaaucuuggagaaauaacauccuccggacacaagaguccgagugugcgugcgugaaugggagcuguuucaccgugaugacggauggaccuucugacggccaggccagcuacaagauuuuucgcaucgaaaaaggcaagaucgucaaauccguugagaugaacgcuccgaauuaucauuacgaagagugcucuuguuaccccgauagcuccgagauuacaugcgugugcagagacaacuggcacgggagcaaucggccuugggugucuuucaaccagaaucuggaauaucagaucggauacauuuguuccggcaucuuuggggauaacccccgcccuaaugacaagaccggaagcugcggccccgucucuuccaacggggccaauggagugaagggcuucagcuuuaaauauggcaacgggguuuggauuggaagaacaaaguccaucucuagccggaacggcuucgagaugauuugggauccgaauggguggaccggaaccgacaacaauuuuuccaucaaacaagacaucgugggcauuaacgaauggucuggguacagcggcuccuucguccagcauccugagcuuacaggacuggauuguauccgccccugcuucuggguggaacucauuagaggccggccuaaggagaauacgaucuggaccagcgggucuuccauuagcuuuuguggaguuaacucugacacagugggcugguccuggcccgauggggcugagcugcccuucaccaucgacaaauga

SEQ ID NO: 201988 - RNA, 1410 nt, Artificial Sequence; identical to SEQ ID NO: 199762
  derived and/or modified sequence opt5 from neuraminidase__InfluenzaA__ADJ18166

SEQ ID NO: 201989 - RNA, 1410 nt, Artificial Sequence; identical to SEQ ID NO: 199762
  derived and/or modified sequence opt5 from neuraminidase__InfluenzaA__ADJ18168

SEQ ID NO: 201990 - RNA, 1410 nt, Artificial Sequence; identical to SEQ ID NO: 199762
  derived and/or modified sequence opt5 from neuraminidase__InfluenzaA__ADJ18170

SEQ ID NO: 201991 - RNA, 1410 nt, Artificial Sequence
  derived and/or modified sequence opt5 from neuraminidase__InfluenzaA__ADJ18172
augaaccccaaucagaagaucauuaccaucggcagcgugugcaugacaauugggauggccaaccugauccucagaauuggaaauaucaucuccauuuggaucucucacagcauucaacugggcaaccagaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuaccggaaggacaacagcauccgcaucgggucuaaaggagauguguuugucauuagagagccguucaucuccuguagcccccucgaaugccggaccuuuuuccugacacagggcgcccuucugaaugacaagcauucuaacggcaccauuaaagaucgcuccccuuauagaacgcucaugagcugucccaucggggaggugccuucucccuacaacucccgguuugaaagcguugccugguccgcuucugccugccacgacggaauuaauuggcugaccaucggcaucagcgggccugauaacggagcuguggccguccugaaguauaauggcauuaucacagacaccauuaaguccuggcgcaacaauauccucagaacacaggagagcgagugugcgugcgugaacgggucuuguuucaccgugaugacggauggaccguccgacggccaagccagcuacaaaauuuuucggaucgaaaagggcaaaaucgucaagucuguugagaugaaugcucccaacuaucauuacgaagagugcagcuguuacccugauuccucugagauuacaugcgugugccgcgacaauuggcacgggagcaacagacccuggguguccuucaaucagaaccuggaauaucagaucggauacauuuguagcggcaucuuuggggauaauccucggcccaacgacaaaaccggaucuugcggcccggucuccagcaauggggccaacggagugaagggcuucucuuuuaaguauggcaacgggguuuggauuggacgcacaaaauccaucagcuccagaaauggcuucgagaugauuugggauccuaacggguggaccggaaccgacaauaacuuuucuaucaagcaggacaucgugggcauuaaugaauggagcggguacuccggcucuuucguccaacaucccgagcuuacaggacuggauuguauccggccuugcuucuggguggaacucauucgcggcagacccaaagagaacacgaucuggaccagcggguccagcauuucuuuuuguggaguuaauuccgacacagugggcuggagcuggcccgauggggcugagcugccuuucaccaucgacaaguga

SEQ ID NO: 201992 - RNA, 1410 nt, Artificial Sequence; identical to SEQ ID NO: 199762
  derived and/or modified sequence opt5 from neuraminidase__InfluenzaA__ADJ18174

SEQ ID NO: 201993 - RNA, 1410 nt, Artificial Sequence
  derived and/or modified sequence opt5 from neuraminidase__InfluenzaA__ADJ18176
augaaccccaaucagaagaucauuaccaucggcagcgugugcaugacaauugggauggccaaccugauccuccaaauuggaaauaucaucuccauuuggaucucucugagcauucagcuuggcaaccagaaucagaucgagacguguaaccaauccgucauuaccuacgaaaauaacacauggguuaaucagaccuaugugaacaucucuaauacaaacuucgcugccgggcagagcguggucuccgugaaacuggcgggaaauucuagccucugcccuguuuccggcugggcuauuuacagcaaggacaacucuaucagaaucggguccaaaggagauguguuugucauucgggagccguucaucagcuguucuccccuggaaugccgcaccuuuuuccuuacacagggcgcccugcucaaugacaagcacuccaacggcaccauuaaagauagaagcccuuaucggacgcugaugucuugucccaucggggaggugccuucccccuacaacagccgcuuugaauccguugccuggucugcuagcgccugccaugacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucacuacgaagagugcuccuguuacccugauucuagcgagauuacaugcgugugcagagacaauuggcauggguccaaccggcccugggugagcuucaaucagaaccuugaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaccccgagcugacaggacucgauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 201994 - RNA, 1410 nt, Artificial Sequence; identical to SEQ ID NO: 199535
  derived and/or modified sequence opt5 from neuraminidase__InfluenzaA__ADJ37250

SEQ ID NO: 201995 - RNA, 1410 nt, Artificial Sequence
  derived and/or modified sequence opt5 from neuraminidase__InfluenzaA__ADJ37252
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaucgugcgggaucgcaccccguauagaacgcuccugaugaaugaacugggcguccccuuucaccucgggacaaaacaggugugcauugccugguccucuagcuccugucaugacggaaaggccuggcugcacguuugcaucaccggcgaugacaagaacgcuacagccagcuucauuuacaauggccggcuuguggauucugucguguccuggagcaaagacauccugcgcacccaggagucugaaugugugugcauuaacgggaccuguacagucguuaugacggauggauccgcuagcggcaaggccgacaccaaaauccucuuuaucgaggaggggaagauugugcauacauccacccugucuggaagcgcgcaacacguggaagagugcuccugcuauccuagauaccccggcguccggugugugugccgcgauaacuggaaggggagcaauagaccuaucguugacauuaacaucaaagaccacucuauuguguccagcuacgucuguucuggacuugugggcgauacaccccggaagaaugacagcuccucuagcucccauugccuggauccgaacaaugaagagggcgggcacggaguuaaaggcugggccuucgacgaugggaacgacguguggaugggacgcaccaucagcgaaaagucuagacucggcuaugagacguuuaaagucaucgaggggugguccaauccuaagagcaaacugcagauuaaccgccaggugaucgucgaucggggaaauagaucuggcuacuccggcauuuucagcguggaagggaaguccuguaucaaccggugcuuuuauguugagcugauuagaggacgcaaggaagagacagaagugcucuggaccucuaauagcaucgucguguucuguggcaccuccgggacauacggaaccggcucuuggcccgacggggcuaacauuaaucugaugccuaucuga

SEQ ID NO: 201996 - RNA, 1410 nt, Artificial Sequence; identical to SEQ ID NO: 199762
  derived and/or modified sequence opt5 from neuraminidase__InfluenzaA__ADJ37263

SEQ ID NO: 201997 - RNA, 1410 nt, Artificial Sequence; identical to SEQ ID NO: 199752
  derived and/or modified sequence opt5 from neuraminidase__InfluenzaA__ADJ37273

SEQ ID NO: 201998 - RNA, 1410 nt, Artificial Sequence; identical to SEQ ID NO: 199762
  derived and/or modified sequence opt5 from neuraminidase__InfluenzaA__ADJ40447

SEQ ID NO: 201999 - RNA, 1410 nt, Artificial Sequence; identical to SEQ ID NO: 199762
  derived and/or modified sequence opt5 from neuraminidase__InfluenzaA__ADJ40457

SEQ ID NO: 202000 - RNA, 1410 nt, Artificial Sequence; identical to SEQ ID NO: 201113
  derived and/or modified sequence opt5 from neuraminidase__InfluenzaA__ADJ40467

SEQ ID NO: 202001 - RNA, 1410 nt, Artificial Sequence
  derived and/or modified sequence opt5 from neuraminidase__InfluenzaA__ADJ40477
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuauuacuacgaagagugcuccuguuauccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacaaugggcuggucuuggcccgauggggcugagcugccuuucaccaucgacaaguga

SEQ ID NO: 202002 - RNA, 1410 nt, Artificial Sequence; identical to SEQ ID NO: 199762
  derived and/or modified sequence opt5 from neuraminidase__InfluenzaA__ADJ40487

SEQ ID NO: 202003 - RNA, 1410 nt, Artificial Sequence; identical to SEQ ID NO: 199762
  derived and/or modified sequence opt5 from neuraminidase__InfluenzaA__ADJ40507

SEQ ID NO: 202004 - RNA, 1410 nt, Artificial Sequence; identical to SEQ ID NO: 199762
  derived and/or modified sequence opt5 from neuraminidase__InfluenzaA__ADJ40517

SEQ ID NO: 202005 - RNA, 1410 nt, Artificial Sequence; identical to SEQ ID NO: 199762
  derived and/or modified sequence opt5 from neuraminidase__InfluenzaA__ADJ40527

SEQ ID NO: 202006 - RNA, 1410 nt, Artificial Sequence
  derived and/or modified sequence opt5 from neuraminidase__InfluenzaA__ADJ40537
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcggaguguccgucaaacuugcgggcaauucuagccugugcccuguguccgggugggcuauuuacagcaaggacaacucuaucagaaucggauccaaaggcgauguuuuugugauucgggagccguucaucagcuguucuccccucgaaugccgcaccuuuuuccugacacagggcgcccuucugaaugacaagcauuccaacgggaccauuaaagauagaagcccuuaucggacgcucaugucuugucccaucggagaggucccuucccccuacaacagccgcuuugaauccguggccuggucugcuagcgccugccacgacggcauuaauuggcugaccaucgggaucuccggaccugauaacggcgcuguugccgugcugaaguauaaugggauuaucacagacaccauuaagagcuggagaaacaauauccuccggacacaagagucugagugugcgugcgucaacggauccuguuucaccgugaugacggauggcccgagcgacggccaggccucuuacaaaauuuuucgcaucgaaaaggggaaaaucgucaagagcguggagaugaaugcucccaacuaucauuacgaagagugcuccuguuacccugauucuagcgagauuacaugcguuugcagagacaauuggcacggauccaaccggcccugggugagcuucaaucagaaccuggaauaucagaucggcuacauuuguucugggaucuuuggagauaauccucgccccaacgacaaaaccggcuccugcgggccggugagcucuaauggagccaacggcgucaagggcuucuccuuuaaguaugggaacggaguguggauuggcagaacaaaaagcaucuccucucggaauggguucgagaugauuugggauccuaacggauggaccggcaccgacaauaacuuuagcaucaagcaagacaucguugggauuaaugaaugguccggcuacucuggcagcuucgugcagcaucccgagcuuacaggacuggauuguauccgcccuugcuucugggucgaacucauuagagggcggcccaaagagaacacgaucuggaccuccggaagcucuauuuccuuuuguggcgugaauagcgacacaguuggguggucuuggcccgauggagcugagcugccuuucaccaucgacaaguga

SEQ ID NO: 202007 - RNA, 1410 nt, Artificial Sequence
  derived and/or modified sequence opt5 from neuraminidase__InfluenzaA__ADJ40547
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucauuaagagcgucgagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuaucggcauuaaugaaugguccggguacucuggcagcuucguucagcaucccgagcuuacaggacuggauuguauccgcccuugcuucuggguggaacucauuagaggccggcccaaagagaacacgaucuggaccuccgggagcucuaucuccuuuuguggagucaauagcgacacagugggcuggucuuggcccgauggggcugagcugccuuucaccauugacaaguga

SEQ ID NO: 202008 - RNA, 1410 nt, Artificial Sequence; identical to SEQ ID NO: 199762
  derived and/or modified sequence opt5 from neuraminidase__InfluenzaA__ADJ40557

SEQ ID NO: 202009 - RNA, 1410 nt, Artificial Sequence; identical to SEQ ID NO: 199762
  derived and/or modified sequence opt5 from neuraminidase__InfluenzaA__ADJ40577

SEQ ID NO: 202010 - RNA, 1410 nt, Artificial Sequence; identical to SEQ ID NO: 199762
  derived and/or modified sequence opt5 from neuraminidase__InfluenzaA__ADJ40587

SEQ ID NO: 202011 - RNA, 1410 nt, Artificial Sequence
  derived and/or modified sequence opt5 from neuraminidase__InfluenzaA__ADJ40597
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuucuuaucaagcaagacaucgugggcauuaaugaauggagcggguacuccggcucuuucguccagcaucccgagcugacaggacucgauuguauccgcccuugcuucuggguggaacugauuagaggccggcccaaagagaacacgaucuggaccagcggguccagcauuucuuuuuguggaguuaauuccgacacagugggcuggagcuggcccgauggggcugagcuuccuuucaccaucgacaaguga

SEQ ID NO: 202012 - RNA, 1410 nt, Artificial Sequence; identical to SEQ ID NO: 199762
  derived and/or modified sequence opt5 from neuraminidase__InfluenzaA__ADJ40607

SEQ ID NO: 202013 - RNA, 1410 nt, Artificial Sequence; identical to SEQ ID NO: 199762
  derived and/or modified sequence opt5 from neuraminidase__InfluenzaA__ADJ40617

SEQ ID NO: 202014 - RNA, 1410 nt, Artificial Sequence; identical to SEQ ID NO: 200116
  derived and/or modified sequence opt5 from neuraminidase__InfluenzaA__ADJ40627

SEQ ID NO: 202015 - RNA, 1410 nt, Artificial Sequence; identical to SEQ ID NO: 199762
  derived and/or modified sequence opt5 from neuraminidase__InfluenzaA__ADJ40637

SEQ ID NO: 202016 - RNA, 1410 nt, Artificial Sequence; identical to SEQ ID NO: 199762
  derived and/or modified sequence opt5 from neuraminidase__InfluenzaA__ADJ40657

SEQ ID NO: 202017 - RNA, 1410 nt, Artificial Sequence; identical to SEQ ID NO: 199762
  derived and/or modified sequence opt5 from neuraminidase__InfluenzaA__ADJ40667

SEQ ID NO: 202018 - RNA, 1410 nt, Artificial Sequence; identical to SEQ ID NO: 199762
  derived and/or modified sequence opt5 from neuraminidase__InfluenzaA__ADJ40677

SEQ ID NO: 202019 - RNA, 1410 nt, Artificial Sequence
  derived and/or modified sequence opt5 from neuraminidase__InfluenzaA__ADJ41819
augaaccccaaucagaagaucauuaccaucggcagcgugucccugacaauugccacgaucugcuuccucaugcaaauugcuauccuggucaccacaguuacccuucacuuuaaacaguacgaguguucuagcccuccgaacaaucagguggugcccugcgaaccuaucauuaucgagagaaacauuacagaaaucgucuaucugaccaauacaaccauugagaaggaaaucugucccaaacucguggaguaccggaacugguccaagccucagugcaaaauuacgggguucgcccccuuuucuaaggacaauagcauccgccuguccgcgggaggcgauaucuggguuaccagagagccuuaugugucuugugacccggggaagugcuaccaauucgcucuuggacagggcacaacccuggauaacaaacauagcaaugacacaauucacgaucggacccccuaucgcacgcuccugaugaacgaacugggggucccuuuucaucucggaacaagacagguguguaucgccugguccuccucuuccugccacgacggcaaggccuggcugcauguuuguauuaccggcuacgauaaaaaugcuacagccagcuucaucuaugacgggcggcuuguggauucuauuggauccuggagcaagaacauccugcgcacccaggagucugaaugcgucuguaucaaugggaccugcacaguggugaugacggacggcuccgcuagcgagagagccgauaccaaaauucucuuuaucgaggaaggaaagauuguccacaucagcccccugucuggcagcgcgcaacacguugaggaaugcuccuguuacccucgguaccccggggugcgcugcguguguagagacaacuggaagggaagcaaucggccggucguggauauuaacguuaaagacuauucuaucguguccagcuacgucugcucuggccuugugggcgacacaccucgcaagaacgauagaagcuccucuagcuauugucggaaucccaacaaugagaaagggaaccauggaguuaagggcugggccuucgacgaugggaaugacguguggaugggacgcaccaucuccgaagagagcagaucuggcuacgagacauuuaaagucauugggggaugguccaccccuaacagcaagcugcagaucaauagacaggugauugucgauucuggcaaccgguccggcuauagcgggaucuucuccguggaaggaaaaucuugcauuaaucgcuguuuuuacguugagcucauccggggcagagaacaggagacgcgcgugugguggacaagcaacuccauugucguguucugcgggaccucuggaaccuauggcacagggagcuggcccgacggcgcugauaucaaucugaugcccaucuga

SEQ ID NO: 202020 - RNA, 1410 nt, Artificial Sequence; identical to SEQ ID NO: 199762
  derived and/or modified sequence opt5 from neuraminidase__InfluenzaA__ADJ56642

SEQ ID NO: 202021 - RNA, 1410 nt, Artificial Sequence; identical to SEQ ID NO: 199762
  derived and/or modified sequence opt5 from neuraminidase__InfluenzaA__ADJ56652

SEQ ID NO: 202022 - RNA, 1410 nt, Artificial Sequence; identical to SEQ ID NO: 199762
  derived and/or modified sequence opt5 from neuraminidase__InfluenzaA__ADJ80637

SEQ ID NO: 202023 - RNA, 1410 nt, Artificial Sequence; identical to SEQ ID NO: 200780
  derived and/or modified sequence opt5 from neuraminidase__InfluenzaA__ADJ80647

SEQ ID NO: 202024 - RNA, 1410 nt, Artificial Sequence; identical to SEQ ID NO: 200780
  derived and/or modified sequence opt5 from neuraminidase__InfluenzaA__ADJ80657

SEQ ID NO: 202025 - RNA, 1410 nt, Artificial Sequence; identical to SEQ ID NO: 199762
  derived and/or modified sequence opt5 from neuraminidase__InfluenzaA__ADJ80667

SEQ ID NO: 202026 - RNA, 1410 nt, Artificial Sequence; identical to SEQ ID NO: 201675
  derived and/or modified sequence opt5 from neuraminidase__InfluenzaA__ADJ80677

SEQ ID NO: 202027 - RNA, 1410 nt, Artificial Sequence; identical to SEQ ID NO: 201050
  derived and/or modified sequence opt5 from neuraminidase__InfluenzaA__ADJ80687

SEQ ID NO: 202028 - RNA, 1410 nt, Artificial Sequence
  derived and/or modified sequence opt5 from neuraminidase__InfluenzaA__ADJ80697
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcgugauuuccgucaaacuugcgggaaauucuagccugugcccuguguccggcugggcuaucuacagcaaggacaacucuguuagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202029 - RNA, 1410 nt, Artificial Sequence
  derived and/or modified sequence opt5 from neuraminidase__InfluenzaA__ADJ80717
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuguguacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggcugagcugccuuucaccauugacaaguga

SEQ ID NO: 202030 - RNA, 1410 nt, Artificial Sequence
  derived and/or modified sequence opt5 from neuraminidase__InfluenzaA__ADJ80727
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggugauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaucggauacauuuguucuggcaucuuuggggauaauccucgccccaacgacaaaaccggauccugcggcccggugagcucuaauggggcuaacggaguuaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucgucggcauuaaugaaugguccggguacucuggcagcuucgugcagcaucccgagcuuacaggacuggauuguauccgcccuugcuucuggguugaacucauuagaggccggcccaaagagaacacgaucuggaccuccgggagcucuauuuccuuuuguggagugaauagcgacacagucggcuggucuuggcccgauggggccgagcugccuuucaccaucgacaaguga

SEQ ID NO: 202031 - RNA, 1410 nt, Artificial Sequence; identical to SEQ ID NO: 200529
  derived and/or modified sequence opt5 from neuraminidase__InfluenzaA__ADJ80737

SEQ ID NO: 202032 - RNA, 1410 nt, Artificial Sequence
  derived and/or modified sequence opt5 from neuraminidase__InfluenzaA__ADJ80747
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaucuagcucccugugcccuguuagcggcugggcuauuuacucuaaggacaauuccaucagaaucgggagcaaaggagauguguuugucauucgggagccguucaucucuuguucuccccucgaaugccgcaccuuuuuccugacacagggcgcccuucugaacgacaagcauagcaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaagaggcaagaucgucaaauccguugagaugaacgcucccaauuaucauuacgaagagugcucuuguuacccugauagcuccgagauuacaugcgugugccgggacaacuggcacgggagcaaucgccccugggugucuuucaaccagaaucuggaauaucagaucggauacauuuguuccggcaucuuuggggauaacccuagacccaaugacaagaaaggaagcugcggcccggucucuuccaacggggccaauggagugaagggcuucagcuuuaaguauggcaacgggguuuggauuggacggaccaaauccaucucuagccgcaacggcuucgagaugauuugggauccuaauggguggacaggaaccgacaacaauuuuuccaucaagcaagacaucguggaaauuaacgaguggucuggcuacagcggguccuucguccagcaucccgaacuuaccggccuggauuguaucagaccuugcuucuggguggagcucauucggggacgccccaaagagaauacaaucuggacgagcggcuccuccauuagcuuuugugggguuaacucugacaccgugggaugguccuggcccgauggcgcugaacugccuuucacaaucgacaaguga

SEQ ID NO: 202033 - RNA, 1410 nt, Artificial Sequence; identical to SEQ ID NO: 199762
  derived and/or modified sequence opt5 from neuraminidase__InfluenzaA__ADJ80757

SEQ ID NO: 202034 - RNA, 1410 nt, Artificial Sequence; identical to SEQ ID NO: 199762
  derived and/or modified sequence opt5 from neuraminidase__InfluenzaA__ADJ80767

SEQ ID NO: 202035 - RNA, 1410 nt, Artificial Sequence; identical to SEQ ID NO: 200345
  derived and/or modified sequence opt5 from neuraminidase__InfluenzaA__ADJ80777

SEQ ID NO: 202036 - RNA, 1410 nt, Artificial Sequence; identical to SEQ ID NO: 199762
  derived and/or modified sequence opt5 from neuraminidase__InfluenzaA__ADJ80787

SEQ ID NO: 202037 - RNA, 1410 nt, Artificial Sequence
  derived and/or modified sequence opt5 from neuraminidase__InfluenzaA__ADJ80797
augaaccccaaucagaagaucauuaccaucggcagcgugugcaugacaauugggauggccaaccugauccuccaaauuggaaauaucaucuccauuuggaucucucacagcauucagcugggcaacaaaaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaagaagggauccugcggcccggucagcucuaauggggccaacggagugaaaggcuucuccuuuaaguauggcaacgggguuuggauuggaagaaccaaaagcaucuccucucggaauggcuucgagaugauuugggauccuaacggguggacaggaaccgacaauaacuuuagcaucaagcaggacaucgugggcauuaaugaaugguccggguacucuggcagcuucguccaacaucccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggcugagcugccuuucacaaucgacaaguga

SEQ ID NO: 202038 - RNA, 1410 nt, Artificial Sequence; identical to SEQ ID NO: 200780
  derived and/or modified sequence opt5 from neuraminidase__InfluenzaA__ADJ80807

SEQ ID NO: 202039 - RNA, 1410 nt, Artificial Sequence; identical to SEQ ID NO: 199762
  derived and/or modified sequence opt5 from neuraminidase__InfluenzaA__ADJ80817

SEQ ID NO: 202040 - RNA, 1410 nt, Artificial Sequence; identical to SEQ ID NO: 199762
  derived and/or modified sequence opt5 from neuraminidase__InfluenzaA__ADJ80827

SEQ ID NO: 202041 - RNA, 1410 nt, Artificial Sequence; identical to SEQ ID NO: 201275
  derived and/or modified sequence opt5 from neuraminidase__InfluenzaA__ADJ80837

SEQ ID NO: 202042 - RNA, 1410 nt, Artificial Sequence; identical to SEQ ID NO: 201773
  derived and/or modified sequence opt5 from neuraminidase__InfluenzaA__ADJ80851

SEQ ID NO: 202043 - RNA, 1410 nt, Artificial Sequence
  derived and/or modified sequence opt5 from neuraminidase__InfluenzaA__ADJ80861
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcccuaauggggccaacggagugaagggcuucucuuuuaaguauggcaacgggguuuggauuggaagaacaaaauccaucagcucccggaauggcuucgagaugauuugggaucccaacggguggaccggaaccgacaauaacuuuucuaucaagcaagacaucgugggcauuaaugaauggagcggguacuccggcucuuucguccagcauccugagcuuacaggacuggauuguauccgccccugcuucuggguggaacucauuagaggccggcccaaagagaacacgaucuggaccagcggguccagcauuucuuuuuguggaguuaauuccgacacagugggcuggagcuggccugauggggcugagcugccguucaccaucgacaaguga

SEQ ID NO: 202044 - RNA, 1410 nt, Artificial Sequence; identical to SEQ ID NO: 202037
  derived and/or modified sequence opt5 from neuraminidase__InfluenzaA__ADJ80871

SEQ ID NO: 202045 - RNA, 1410 nt, Artificial Sequence; identical to SEQ ID NO: 199762
  derived and/or modified sequence opt5 from neuraminidase__InfluenzaA__ADJ80886

SEQ ID NO: 202046 - RNA, 1410 nt, Artificial Sequence
  derived and/or modified sequence opt5 from neuraminidase__InfluenzaA__ADJ80896
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaaaauaacacaugggucaaucagaccuauguuaacauuucuaauacaaacuucgcugccgggcagagcgugguguccgucaaacuuaccggaaauucuagccugugcccuguguccggcugggcgaucuacagcaaggacaacucuaucagaauuggguccaaaggagauguuuuugugauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggucccuucccccuacaacagccgcuuugaauccguggcuuggucugccagcgcuugccacgacggaaucaauuggcugacaaucggcauuuccgggccugauaacggagccguugcugugcugaaguauaauggcaucauuaccgacacaaucaagagcuggagaaacaauauucuccggacccaagagucugagugugccugcgucaacggguccuguuucacggugaugacagauggaccgagcgacggccaggcgucuuacaaaaucuuucgcaucgaaaagggcaaaauugucaagagcguggagaugaaugcccccaacuaucauuacgaagagugcuccuguuacccugauucuagcgagauuaccugcguuugcagagacaauuggcacggguccaaccggcccugggugagcuucaaucagaaccuggaauaucagaucggauacaucuguucuggcauuuuuggggauaauccucgccccaacgacaaaacaggauccugcggcccggugagcucuaauggggcuaacggagucaagggcuucuccuuuaaguauggcaacgggguguggaucggaagaaccaaaagcauuuccucucggaauggcuucgagaugaucugggauccuaacggguggaccggaacagacaauaacuuuagcaucaagcaagacauuguuggcaucaaugaaugguccggguacucuggcagcuucgugcagcaucccgagcuuacgggacuggauuguauucgcccuugcuucugggucgaacucaucagaggccggcccaaagagaacaccauuuggacauccgggagcucuaucuccuuuuguggagugaauagcgacaccguuggcuggucuuggcccgauggggccgagcugccuuucacaaucgacaaguga

SEQ ID NO: 202047 - RNA, 1410 nt, Artificial Sequence
  derived and/or modified sequence opt5 from neuraminidase__InfluenzaA__ADJ80913
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaucuagcucccugugcccuguuagcggcugggcuauuuacucuaaggacaauuccaucagaaucgggagcaaaggagauguguuugucauucgggagccguucaucucuuguagcccccucgaaugccgcaccuuuuuccugacacagggcgcccuucugaacgacaagcauuccaauggcaccauuaaagauagaucuccuuaucggacgcucauguccugucccaucggggaggugccuagccccuacaacucccgcuuugaaucuguugccuggagcgcuuccgccugccacgacggaauuaacuggcugaccaucggcaucagcgggccugauaauggagcuguggccguccugaaguauaacggcauuaucacagacaccauuaagucuuggagaaauaacauccuccggacacaagaguccgagugugcgugcgugaaugggagcuguuucaccgugaugacggauggaccgucugacggccaggccagcuacaaaauuuuucgcaucgaaaagggcaaaaucgucaaguccguugagaugaacgcucccaauuaucauuacgaagagugcucuuguuacccugauagcuccgagauuacaugcgugugcagagacaacuggcacgggagcaaucggcccugggugucuuucaaccagaaucuggaauaucagaucggauacauuuguuccggcaucuuuggggauaacccucgccccaaugacaaaaagggaagcugcggcccggucucuuccaacggggccaauggagugaagggcuucagcuuuaaauauggcaacgggguuuggauuggaagaaccaaguccaucucuagccgguccggcuucgagaugauuugggauccuaacggguggacaggaaccgacaauaacuuuucuaucaaacaagacaucgugggcauuaaugaauggagcggguacuccggcagcuucguccagcaucccgagcuuaccggacuggauuguauccgcccuugcuucuggguggaacucauuagaggccggcccaaggagaacacaaucuggacgucuggguccagcauuucuuuuuguggaguuaauuccgacaccgugggcuggagcuggcccgauggggcugagcugccuuucacaaucgacaaauga

SEQ ID NO: 202048 - RNA, 1410 nt, Artificial Sequence; identical to SEQ ID NO: 199762
  derived and/or modified sequence opt5 from neuraminidase__InfluenzaA__ADJ80930

SEQ ID NO: 202049 - RNA, 1410 nt, Artificial Sequence; identical to SEQ ID NO: 199762
  derived and/or modified sequence opt5 from neuraminidase__InfluenzaA__ADJ80950

SEQ ID NO: 202050 - RNA, 1410 nt, Artificial Sequence; identical to SEQ ID NO: 201050
  derived and/or modified sequence opt5 from neuraminidase__InfluenzaA__ADJ80960

SEQ ID NO: 202051 - RNA, 1410 nt, Artificial Sequence; identical to SEQ ID NO: 202037
  derived and/or modified sequence opt5 from neuraminidase__InfluenzaA__ADJ80970

SEQ ID NO: 202052 - RNA, 1410 nt, Artificial Sequence; identical to SEQ ID NO: 199762
  derived and/or modified sequence opt5 from neuraminidase__InfluenzaA__ADJ80980

SEQ ID NO: 202053 - RNA, 1410 nt, Artificial Sequence; identical to SEQ ID NO: 202037
  derived and/or modified sequence opt5 from neuraminidase__InfluenzaA__ADJ80996

SEQ ID NO: 202054 - RNA, 1410 nt, Artificial Sequence
  derived and/or modified sequence opt5 from neuraminidase__InfluenzaA__ADJ81006
augaaccccaaucagaagaucauuaccaucggcagcgugugcaugacaauugggauggccaaccugauccuccaagucggaaauauuaucuccaucuggauuucucacagcauccagcugggcaaccagaaucagauugagacguguaaccaauccaucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaccuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 202055 - RNA, 1410 nt, Artificial Sequence; identical to SEQ ID NO: 201773
  derived and/or modified sequence opt5 from neuraminidase__InfluenzaA__ADJ81016

SEQ ID NO: 202056 - RNA, 1410 nt, Artificial Sequence; identical to SEQ ID NO: 201962
  derived and/or modified sequence opt5 from neuraminidase__InfluenzaA__ADJ81026

SEQ ID NO: 202057 - RNA, 1410 nt, Artificial Sequence; identical to SEQ ID NO: 199762
  derived and/or modified sequence opt5 from neuraminidase__InfluenzaA__ADJ81036

SEQ ID NO: 202058 - RNA, 1410 nt, Artificial Sequence
  derived and/or modified sequence opt5 from neuraminidase__InfluenzaA__ADJ81046
augaaccccaaucagaagaucauuaccaucggcagcgugugcaugacagucgggauggccaaccugauucuccaaaucggaaauauuaucuccaucuggauuucucacagcauccagcugggcaaccagaaucagauugagacguguaaccaauccguuaucaccuacgaaaauaacacaugggugaaucagaccuaugugaacauuucuaauacaaacuucgcugccgggcagagcgucguguccguuaaacuugcgggaaauucuagccugugcccuguguccggcugggcuaucuacagcaaggacaacucuauuagaaucggguccaaaggagaugucuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggagguuccuucccccuacaacagccgcuuugaauccguggccuggucugcuagcgccugccacgacggaaucaauuggcugaccauuggcaucuccgggccugauaacggagcugucgccgugcugaaguauaauggcaucauuacagacaccaucaagagcuggagaaacaauauucuccggacacaagagucugagugugcgugcgugaacggguccuguuucaccgucaugacggauggaccgagcgacggccaggccucuuacaaaaucuuucgcauugaaaagggcaaaaucguuaagagcguggagaugaaugcucccaacuaucauuacgaagagugcuccuguuacccugauucuagcgagaucacaugcgugugcagagacaauuggcacggguccaaccggcccugggucagcuucaaucagaaccuggaauaucagauuggauacaucuguucuggcauuuuuggggauaauccucgccccaacgacaaaaccggauccugcggcccggugagcucuaauggggccaacggaguuaagggcuucuccuuuaaguauggcaacgggguguggaucggaagaacaaaaagcauuaauucccggaacggcuucgagaugaucugggauccuaauggguggaccggaaccgacaacaauuuuucuauuaagcaagacaucgucggcacaaacgaauggagcggguacuccggcucuuucgugcagcaucccgagcuuacgggacuggauuguauccgcccuugcuucuggguugaacucauuagaggccggcccaaagagaauaccaucuggacaagcggguccagcauuucuuuuuguggagugaacuccgacaccgucggcuggagcuggcccgauggggcugagcugccuuucacaaucgacaaguga

SEQ ID NO: 202059 - RNA, 1410 nt, Artificial Sequence
  derived and/or modified sequence opt5 from neuraminidase__InfluenzaA__ADJ81056
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucccugugaaacuugcgggauccucuagccugugcccgguuuccggcugggcuauuuacagcaaggacaauucuaucagaaucggguccaaaggagauguguuugucauucgggagcccuucaucagcuguucuccucucgaaugccgcaccuuuuuccugacacagggcgcccuucugaacgacaagcauuccaauggcaccauuaaagauagaagccccuaucggacgcucaugucuuguccuaucggggaggugcccuccccuuacaacagccgcuuugaauccguugccuggucugcuagcgccugccacgacggaauuaacuggcugaccaucggcaucuccgggccggauaauggagcuguggccguccugaaguauaacggcauuaucacagacaccauuaagagcuggagaaauaacauccuccggacacaagagucugagugugcgugcgugaauggguccuguuucaccgugaugacggauggacccagcgacggccaggccucuuacaaaauuuuucgcaucgaaaagggcaaaaucgucaagagcguugagaugaacgcuccuaauuaucauuacgaagagugcuccuguuaccccgauucuagcgagauuacaugcgugugcagagacaacuggcacggguccaaucggccuugggugagcuucaaccagaaucuggaauaucagaucggauacauuuguucuggcaucuuuggggauaacccccgcccgaaugacaaaaagggauccugcggcccugucagcucuaacggggccaauggagugaagggcuucuccuuuaaauauggcaacgggguuuggauuggaagaaccaagagcaucaacucccggaauggcuucgagaugauuugggaucccaacggguggacaggaaccgacaauaacuuuucuaucaaacaagacaucgugggcauuaaugaauggagcggguacuccggcucuuucguccagcauccugagcuuaccggacuggauuguauccgccccugcuucuggguggaacucauuagaggccggcccaaggagaacacaaucuggacgagcggguccagcauuucuuuuuguggaguuaauuccgacaccgugggcuggagcuggccugauggggcugagcugccguucacaaucgacaaauga

SEQ ID NO: 202060 - RNA, 1410 nt, Artificial Sequence; identical to SEQ ID NO: 201050
  derived and/or modified sequence opt5 from neuraminidase__InfluenzaA__ADJ81066

SEQ ID NO: 202061 - RNA, 1410 nt, Artificial Sequence; identical to SEQ ID NO: 199623
  derived and/or modified sequence opt5 from neuraminidase__InfluenzaA__ADJ84775

SEQ ID NO: 202062 - RNA, 1410 nt, Artificial Sequence
  derived and/or modified sequence opt5 from neuraminidase__InfluenzaA__ADJ88785
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuguuguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugagacauuuaaagucaucgaagggugguccaaucauaagagcaaacugcagaucaaccgccaggugauugucgaccggggaaauagaucuggcuacuccggcaucuucagcguggaggggaaguccuguauuaaccggugcuuuuauguugaacugaucagaggacgcaaggaggaaaccgaggugcucuggaccucuaauagcauugucguguucuguggcacauccgggaccuacggaacaggcucuuggccugauggggcugaccugaaccuuaugcccaucuga

SEQ ID NO: 202063 - RNA, 1410 nt, Artificial Sequence; identical to SEQ ID NO: 199762
  derived and/or modified sequence opt5 from neuraminidase__InfluenzaA__ADK21716

SEQ ID NO: 202064 - RNA, 1410 nt, Artificial Sequence; identical to SEQ ID NO: 199762
  derived and/or modified sequence opt5 from neuraminidase__InfluenzaA__ADK21726

SEQ ID NO: 202065 - RNA, 1410 nt, Artificial Sequence; identical to SEQ ID NO: 199762
  derived and/or modified sequence opt5 from neuraminidase__InfluenzaA__ADK21736

SEQ ID NO: 202066 - RNA, 1410 nt, Artificial Sequence
  derived and/or modified sequence opt5 from neuraminidase__InfluenzaA__ADK21746
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccauuaucaccuacgaacauaauacaugggucaaccagaccuauguuaauauuucuaacacaaauuucgcugccgggcagagcgugguguccgucaaacuugcgggaaacucuagccugugcccuguguccggcugggcuaucuacagcaaggacaauucuaucagaauuggguccaaaggagauguuuuugugauccgggagccguucauuagcuguucuccccucgaaugccgcaccuuuuuccugacacagggcgcccuucugaacgacaagcacuccaauggcaccaucaaagauagaagcccuuaucggacgcucaugucuugucccauuggggaggucccuucccccuacaacagccgcuuugaauccguggccuggucugcuagcgccugccaugacggaaucaacuggcugaccaucggcauuuccgggccugauaauggagcuguugccgugcugaaguauaacggcaucauuacagacaccaucaagagcuggagaaauaacauucuccggacacaagagucugagugugcgugcgucaauggguccuguuucaccgugaugacggauggaccgagcgacggccaggccucuuacaaaaucuuucgcaucgaaaagggcaaaauugugaagucugucgagaugaacgcucccaauuaucacuacgaagagugcuccuguuacccugauucuagcgagaucacaugcguuugcagagacaacuggcauggguccaaucggcccugggugagcuucaaccagaaucuggaauaucagauuggauacaucuguucuggcauuuuuggggauaacccucgccccaaugacaaaaccggauccugcggcccggugagcucuaacggggccaauggagucaagggcuucuccuuuaaguauggcaacgggguguggaucggaagaacaaaaagcauuuccucucggagcggcuucgagaugaucugggauccuaacggguggaccggaaccgacaauaacuuuuccaucaagcaagacauuguuggcaucaaugaauggucuggguacagcggcuccuucgugcagcaccccgagcuuacaggacuggauuguauucgcccuugcuucugggucgaacucaucagaggccggcccgaggagaacacgauuuggaccagcgggucuuccaucagcuuuuguggagugaauagcgacacaguuggcugguccuggcccgauggggcugaacugccuuucaccaucgacaaauga

SEQ ID NO: 202067 - RNA, 1410 nt, Artificial Sequence; identical to SEQ ID NO: 199762
  derived and/or modified sequence opt5 from neuraminidase__InfluenzaA__ADK21756

SEQ ID NO: 202068 - RNA, 1410 nt, Artificial Sequence; identical to SEQ ID NO: 199762
  derived and/or modified sequence opt5 from neuraminidase__InfluenzaA__ADK21766

SEQ ID NO: 202069 - RNA, 1410 nt, Artificial Sequence; identical to SEQ ID NO: 201193
  derived and/or modified sequence opt5 from neuraminidase__InfluenzaA__ADK21776

SEQ ID NO: 202070 - RNA, 1410 nt, Artificial Sequence; identical to SEQ ID NO: 199762
  derived and/or modified sequence opt5 from neuraminidase__InfluenzaA__ADK21786

SEQ ID NO: 202071 - RNA, 1410 nt, Artificial Sequence; identical to SEQ ID NO: 199762
  derived and/or modified sequence opt5 from neuraminidase__InfluenzaA__ADK21796

SEQ ID NO: 202072 - RNA, 1410 nt, Artificial Sequence; identical to SEQ ID NO: 199762
  derived and/or modified sequence opt5 from neuraminidase__InfluenzaA__ADK21806

SEQ ID NO: 202073 - RNA, 1410 nt, Artificial Sequence; identical to SEQ ID NO: 199762
  derived and/or modified sequence opt5 from neuraminidase__InfluenzaA__ADK21816

SEQ ID NO: 202074 - RNA, 1410 nt, Artificial Sequence; identical to SEQ ID NO: 201740
  derived and/or modified sequence opt5 from neuraminidase__InfluenzaA__ADK21826

SEQ ID NO: 202075 - RNA, 1410 nt, Artificial Sequence; identical to SEQ ID NO: 201653
  derived and/or modified sequence opt5 from neuraminidase__InfluenzaA__ADK21836

SEQ ID NO: 202076 - RNA, 1410 nt, Artificial Sequence
  derived and/or modified sequence opt5 from neuraminidase__InfluenzaA__ADK21846
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaugaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuugggcuuccgggagcucuaucuccuuuuguggaguuaauagcgacaccgugggcuggucuuggcccgauggggccgagcugccuuucacaauugacaaguga

SEQ ID NO: 202077 - RNA, 1410 nt, Artificial Sequence; identical to SEQ ID NO: 199762
  derived and/or modified sequence opt5 from neuraminidase__InfluenzaA__ADK21856

SEQ ID NO: 202078 - RNA, 1410 nt, Artificial Sequence; identical to SEQ ID NO: 199762
  derived and/or modified sequence opt5 from neuraminidase__InfluenzaA__ADK21866

SEQ ID NO: 202079 - RNA, 1410 nt, Artificial Sequence; identical to SEQ ID NO: 199762
  derived and/or modified sequence opt5 from neuraminidase__InfluenzaA__ADK21876

SEQ ID NO: 202080 - RNA, 1410 nt, Artificial Sequence; identical to SEQ ID NO: 199762
  derived and/or modified sequence opt5 from neuraminidase__InfluenzaA__ADK21886

SEQ ID NO: 202081 - RNA, 1410 nt, Artificial Sequence
  derived and/or modified sequence opt5 from neuraminidase__InfluenzaA__ADK21896
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcacaaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuagcucugacaccgugggcugguccuggcccgauggggcugagcugccuuucacaauugacaaguga

SEQ ID NO: 202082 - RNA, 1410 nt, Artificial Sequence
  derived and/or modified sequence opt5 from neuraminidase__InfluenzaA__ADK21906
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccuggaucagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuggcucccggaauggguucgagaugaucugggauccuaacggauggaccggcaccgacaauaacuuuucuaucaagcaagacauuguugggaucaaugaauggagcggcuacuccggaucuuucgugcagcaucccgagcuuacaggccuggauuguauucgcccuugcuucugggucgaacucaucagagggcggcccaaagagaacacgauuuggaccagcggauccagcaucucuuuuuguggcguuaauuccgacacagugggguggagcuggcccgauggagcugagcugccuuucaccaucgacaaguga

SEQ ID NO: 202083 - RNA, 1410 nt, Artificial Sequence; identical to SEQ ID NO: 199762
  derived and/or modified sequence opt5 from neuraminidase__InfluenzaA__ADK21916

SEQ ID NO: 202084 - RNA, 1410 nt, Artificial Sequence; identical to SEQ ID NO: 199762
  derived and/or modified sequence opt5 from neuraminidase__InfluenzaA__ADK21926

SEQ ID NO: 202085 - RNA, 1410 nt, Artificial Sequence; identical to SEQ ID NO: 199762
  derived and/or modified sequence opt5 from neuraminidase__InfluenzaA__ADK21936

SEQ ID NO: 202086 - RNA, 1410 nt, Artificial Sequence
  derived and/or modified sequence opt5 from neuraminidase__InfluenzaA__ADK21946
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggaauggauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcucccuuucaccaucgacaaguga

SEQ ID NO: 202087 - RNA, 1410 nt, Artificial Sequence
  derived and/or modified sequence opt5 from neuraminidase__InfluenzaA__ADK21956
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuuaagaucgaaaaaggcaagaucgucaaaagcguugagaugaaugcucccaacuaucauuacgaagagugcuccuguuacccugauucuagcgagauuacaugcgugugccgcgacaauuggcacggguccaacagacccugggugagcuucaaucagaaccuggaauaucagaucggauacauuuguucuggcaucuuuggggauaauccucggcccaacgacaagaccggauccugcggcccggucagcucuaauggggccaacggagugaagggcuucuccuuuaaauauggcaacgggguuuggauuggacgcacaaagagcaucuccucuagaaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguauccggccuugcuucuggguggaacucauucgcggcagacccaaggagaacacgaucuggaccuccgggagcucuauuuccuuuuguggaguuaauagcaacacagugggcuggucuuggcccgacggggcugagcugccuuucaccaucgauaaauga

SEQ ID NO: 202088 - RNA, 1410 nt, Artificial Sequence; identical to SEQ ID NO: 199762
  derived and/or modified sequence opt5 from neuraminidase__InfluenzaA__ADK32393

SEQ ID NO: 202089 - RNA, 1410 nt, Artificial Sequence; identical to SEQ ID NO: 199762
  derived and/or modified sequence opt5 from neuraminidase__InfluenzaA__ADK32403

SEQ ID NO: 202090 - RNA, 1410 nt, Artificial Sequence; identical to SEQ ID NO: 199762
  derived and/or modified sequence opt5 from neuraminidase__InfluenzaA__ADK32413

SEQ ID NO: 202091 - RNA, 1410 nt, Artificial Sequence
  derived and/or modified sequence opt5 from neuraminidase__InfluenzaA__ADK32423
augaaccccaaucagaagaucauuaccaucggcagcgugugcaugacaauugggaugacgaaccugauccuccaaauuggaaauaucaucuccauuuggaucucucacagcauucagcugggcaaccagaaucagaucgagaccuguaaccaauccgucauuacauacgaaaauaacaccuggguuaaucagacauaugugaacaucucuaauaccaacuucgccgcugggcagagcguggucuccgugaaacuugccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccuuaucggacccucaugucuugucccaucggggaggugccuucccccuacaacagccgcuuugaauccguugcuuggucugccagcgcuugccacgacggaauuaauuggcugacaaucggcaucuccgggccugauaacggagccguggcuguccugaaguauaauggcauuaucaccgacacaauuaagagcuggagaaacaauauccuccggacccaagagucugagugugccugcgugaacggguccuguuucacggugaugacagauggaccgagcgacggccaggcgucuuacaaaauuuuucgcaucgaaaagggcaaaaucgucaagagcguugagaugaaugcccccaacuaucauuacgaagagugcuccuguuacccugauucuagcgagauuaccugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguacucuggcagcuucguccagcaucccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 202092 - RNA, 1410 nt, Artificial Sequence; identical to SEQ ID NO: 199762
  derived and/or modified sequence opt5 from neuraminidase__InfluenzaA__ADK32433

SEQ ID NO: 202093 - RNA, 1410 nt, Artificial Sequence; identical to SEQ ID NO: 199762
  derived and/or modified sequence opt5 from neuraminidase__InfluenzaA__ADK32443

SEQ ID NO: 202094 - RNA, 1410 nt, Artificial Sequence
  derived and/or modified sequence opt5 from neuraminidase__InfluenzaA__ADK32453
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuucuggaaauagcucccugugcccuguuagcggcugggcgauuuacucuaaggacaacuccgugagaaucgggagcaaaggagaugucuuugugauccgggagccguucauuucuuguagcccccucgaaugccgcaccuuuuuccugacacagggcgcccuucugaaugacaagcauuccaacggcaccaucaaagauagaucuccuuaucggacgcucauguccugucccauuggggagguuccuagccccuacaacucccgcuuugaaucuguggcuuggagcgccuccgcuugccacgacggaaucaauuggcugaccauuggcaucagcgggccugauaacggagccgucgcugugcugaaguauaauggcaucauuacagacaccaucaagucuuggagaaacaauauucuccggacacaagaguccgagugugccugcgugaacgggagcuguuucaccgucaugacggauggaccgucugacggccaggcgagcuacaaaaucuuucgcauugaaaagggcaaaaucguuaaguccguggagaugaaugcccccaacuaucauuacgaagagugcucuuguuacccugauagcuccgagaucacaugcgugugcagagacaauuggcacgggagcaaccggcccugggucucuuucaaucagaaccuggaauaucagauuggauacaucuguuccggcauuuuuggggauaauccucgccccaacgacaaaaccggaagcugcggcccggugucuuccaauggggcuaacggaguuaagggcuucagcuuuaaguauggcaacgggguguggaucggaagaacaaaauccauuucuagccggaauggcuucgagaugaucugggauccuaacggguggaccggaaccgacaauaacuuuuccauuaagcaagacaucgucggcaucaaugaauggucuggguacagcggcuccuucgugcagcaucccgagcuuacaggacuggauuguauucgcccuugcuucuggguugaacucaucagaggccggcccaaagagaacacgauuuggaccagcgggucuuccaucagcuuuuguggagucaauucugacacagugggcugguccuggcccgauggggccgagcugccuuucaccauugacaaguga

SEQ ID NO: 202095 - RNA, 1410 nt, Artificial Sequence
  derived and/or modified sequence opt5 from neuraminidase__InfluenzaA__ADK32463
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuuauuaaugacaagcauuccaacggcaccaucaaagauagaagcccuuaucggacgcugaugucuugucccauuggggaggugccuucccccuacaacagccgcuuugaauccguugccuggucugcuagcgccugccacgacggaaucaauuggcucaccaucggcauuuccgggccugauaacggagcuguggccguccugaaguauaauggcaucauuacagacaccaucaagagcuggagaaacaauauucugcggacacaagagucugagugugcgugcgugaacggguccuguuucaccgugaugacggauggaccgagcgacggccaggccucuuacaaaaucuuucgcaucgaaaagggcaaaauugucaagagcguugagaugaaugcucccaacuaucauuacgaagagugcuccuguuacccugauucuagcgagaucacaugcgugugcagagacaauuggcacggguccaaccggcccugggugagcuucaaucagaaccucgaauaucagauuggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcaucaagcaagacauugugggcaucaaugaaugguccggguacucuggcagcuucguccagcaucccgagcugacaggacuugauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcucccuuucaccaucgacaaguga

SEQ ID NO: 202096 - RNA, 1410 nt, Artificial Sequence; identical to SEQ ID NO: 199762
  derived and/or modified sequence opt5 from neuraminidase__InfluenzaA__ADK32473

SEQ ID NO: 202097 - RNA, 1410 nt, Artificial Sequence; identical to SEQ ID NO: 199762
  derived and/or modified sequence opt5 from neuraminidase__InfluenzaA__ADK32483

SEQ ID NO: 202098 - RNA, 1410 nt, Artificial Sequence; identical to SEQ ID NO: 199762
  derived and/or modified sequence opt5 from neuraminidase__InfluenzaA__ADK32493

SEQ ID NO: 202099 - RNA, 1410 nt, Artificial Sequence; identical to SEQ ID NO: 201675
  derived and/or modified sequence opt5 from neuraminidase__InfluenzaA__ADK32505

SEQ ID NO: 202100 - RNA, 1410 nt, Artificial Sequence
  derived and/or modified sequence opt5 from neuraminidase__InfluenzaA__ADK32640
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggcguccgucaaacuugcuggaaauucuagccugugcccuguguccggcugggccauuuacagcaaggacaacucuaucagaaucggguccaaaggagauguuuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggucccuucccccuacaacagccgcuuugaauccguggcuuggucugccagcgcuugccacgacggaauuaauuggcugaccaucggcaucuccgggccugauaacggagccguugcggugcugaaguauaauggcauuaucacagacaccauuaagagcuggagaaacaauauccuccggacacaagagucugagugugccugcgucaacggguccuguuucaccgugaugacggauggaccgagcgacggccaggcuucuuacaaaauuuuucgcaucgaaaagggcaaaaucgucaagagcguggagaugaaugcccccaacuaucauuacgaagagugcuccuguuacccugauucuagcgagauuacaugcguuugcagagacaauuggcacggguccaaccggcccugggugagcuucaaucagaaccuggaauaucagaucggauacauuuguucuggcaucuuuggggauaauccucgccccaacgacaaaaccggauccugcggcccggugagcucuaauggggcuaacggagucaagggcuucuccuuuaaguauggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguacucuggcagcuucgugcagcaucccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggccgagcugccuuucaccaucgacaaguga

SEQ ID NO: 202101 - RNA, 1410 nt, Artificial Sequence; identical to SEQ ID NO: 199762
  derived and/or modified sequence opt5 from neuraminidase__InfluenzaA__ADK32650

SEQ ID NO: 202102 - RNA, 1410 nt, Artificial Sequence; identical to SEQ ID NO: 199762
  derived and/or modified sequence opt5 from neuraminidase__InfluenzaA__ADK32660

SEQ ID NO: 202103 - RNA, 1410 nt, Artificial Sequence; identical to SEQ ID NO: 199762
  derived and/or modified sequence opt5 from neuraminidase__InfluenzaA__ADK32670

SEQ ID NO: 202104 - RNA, 1410 nt, Artificial Sequence
  derived and/or modified sequence opt5 from neuraminidase__InfluenzaA__ADK32680
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacaaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggaaccguucaucagcuguucuccccucgagugccgcaccuuuuuccugacacagggcgcccuucugaaugacaaacauuccaacggcaccauuaaggauagaagcccuuaucggacgcucaugucuugucccaucggggaagugccuucccccuacaacagccgcuuugaguccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaagaaucugagugugcgugcgugaacggguccuguuucaccgugaugacggauggaccgagcgacggccaggccucuuacaagauuuuucgcaucgagaaaggcaagaucgucaaaagcguugaaaugaaugcucccaacuaucauuacgaggaaugcuccuguuacccugauucuagcgagauuacaugcgugugcagagacaauuggcacggguccaaccggcccugggugagcuucaaucagaaccuggaguaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgaaaugauuugggauccuaacggguggaccggaaccgacaauaacuuuagcaucaaacaagacaucgugggcauuaaugagugguccggguacucuggcagcuucguccagcaucccgaacuuacaggacuggauuguauccgcccuugcuucuggguggagcucauuagaggccggcccaaggaaaacacgaucuggaccuccgggagcucuauuuccuuuuguggaguuaauagcgacacagugggcuggucuuggcccgauggggcugagcugccuuucaccaucgacaaauga

SEQ ID NO: 202105 - RNA, 1410 nt, Artificial Sequence; identical to SEQ ID NO: 199762
  derived and/or modified sequence opt5 from neuraminidase__InfluenzaA__ADK32690

SEQ ID NO: 202106 - RNA, 1410 nt, Artificial Sequence; identical to SEQ ID NO: 199762
  derived and/or modified sequence opt5 from neuraminidase__InfluenzaA__ADK32700

SEQ ID NO: 202107 - RNA, 1410 nt, Artificial Sequence; identical to SEQ ID NO: 199762
  derived and/or modified sequence opt5 from neuraminidase__InfluenzaA__ADK32779

SEQ ID NO: 202108 - RNA, 1410 nt, Artificial Sequence; identical to SEQ ID NO: 199762
  derived and/or modified sequence opt5 from neuraminidase__InfluenzaA__ADK33614

SEQ ID NO: 202109 - RNA, 1410 nt, Artificial Sequence; identical to SEQ ID NO: 199762
  derived and/or modified sequence opt5 from neuraminidase__InfluenzaA__ADK33624

SEQ ID NO: 202110 - RNA, 1410 nt, Artificial Sequence; identical to SEQ ID NO: 199762
  derived and/or modified sequence opt5 from neuraminidase__InfluenzaA__ADK33634

SEQ ID NO: 202111 - RNA, 1410 nt, Artificial Sequence
  derived and/or modified sequence opt5 from neuraminidase__InfluenzaA__ADK33644
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggagcgauaacggagcuguggccguccugaaguauaauggcauuaucacagacaccauuaagucuuggagaaacaauauccuccggacacaagaguccgagugugcgugcgugaacgggagcuguuucaccgugaugacggauggaccuucugacggccaggccagcuacaaaauuuuucgcaucgaaaagggcaaaaucgucaaguccguugagaugaaugcuccgaacuaucauuacgaagagugcucuuguuaccccgauagcuccgagauuacaugcgugugcagagacaauuggcacgggagcaaccggccuugggugucuuucaaucagaaccuggaauaucagaucggauacauuuguuccggcaucuuuggggauaauccccgcccuaacgacaaaaccggaagcugcggccccgucucuuccaauggggccaacggagugaagggcuucagcuuuaaguauggcaacgggguuuggauuggaagaacaaaauccaucucuagccggaauggcuucgagaugauuugggauccgaacggguggaccggaaccgacaauaacuuuuccaucaagcaagacaucgugggcauuaaugaauggucuggguacagcggcuccuucguccagcauccugagcuuacaggacuggauuguauccgccccugcuucuggguggaacucauuagaggccggccuaaagagaacacgaucuggaccagcgggucuuccauuagcuuuuguggaguuaauucugacacagugggcugguccuggcccgauggggcugagcugcccuucaccaucgacaaguga

SEQ ID NO: 202112 - RNA, 1410 nt, Artificial Sequence; identical to SEQ ID NO: 201493
  derived and/or modified sequence opt5 from neuraminidase__InfluenzaA__ADK33654

SEQ ID NO: 202113 - RNA, 1410 nt, Artificial Sequence; identical to SEQ ID NO: 201493
  derived and/or modified sequence opt5 from neuraminidase__InfluenzaA__ADK33664

SEQ ID NO: 202114 - RNA, 1410 nt, Artificial Sequence; identical to SEQ ID NO: 199762
  derived and/or modified sequence opt5 from neuraminidase__InfluenzaA__ADK33674

SEQ ID NO: 202115 - RNA, 1410 nt, Artificial Sequence; identical to SEQ ID NO: 199762
  derived and/or modified sequence opt5 from neuraminidase__InfluenzaA__ADK33684

SEQ ID NO: 202116 - RNA, 1410 nt, Artificial Sequence; identical to SEQ ID NO: 201113
  derived and/or modified sequence opt5 from neuraminidase__InfluenzaA__ADK33694

SEQ ID NO: 202117 - RNA, 1410 nt, Artificial Sequence; identical to SEQ ID NO: 199762
  derived and/or modified sequence opt5 from neuraminidase__InfluenzaA__ADK33704

SEQ ID NO: 202118 - RNA, 1410 nt, Artificial Sequence; identical to SEQ ID NO: 199762
  derived and/or modified sequence opt5 from neuraminidase__InfluenzaA__ADK33714

SEQ ID NO: 202119 - RNA, 1410 nt, Artificial Sequence; identical to SEQ ID NO: 199762
  derived and/or modified sequence opt5 from neuraminidase__InfluenzaA__ADK33744

SEQ ID NO: 202120 - RNA, 1410 nt, Artificial Sequence
  derived and/or modified sequence opt5 from neuraminidase__InfluenzaA__ADK33754
augaaccccaaucagaagaucauuaccaucggcagcgugugcaugacaauugggauggccaacuucauccugcaaauuggaaauaucaucuccauuuggaucucucacagcauucagcucggcaaccagaaucagaucgagacguguaaccaauccgucauuaccuacgaaaauaacacauggguuaaucagaccuaugugaacaucucuaauacaaacuuugcugccgggcagagcguggucuccgugaaacuggcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguacucuggcagcuucguccagcaucccgagcugacaggacuugauuguauccgcccuugcuuuuggguggaacugauuagaggccggcccaaagagaacacgaucuggaccuccgggagcucuauuuccuucuguggaguuaauagcgacacagugggcuggucuuggcccgauggggcugagcucccuuuuaccaucgacaaguga

SEQ ID NO: 202121 - RNA, 1410 nt, Artificial Sequence
  derived and/or modified sequence opt5 from neuraminidase__InfluenzaA__ADK33764
augaaccccaaucagaagaucauuaccaucggcagcgugugcaugacaauugggauggccaacuucauccugcaaauuggaaauaucaucuccauuuggaucucucacagcauucagcucggcaaccagaaucagaucgagacguguaaccaauccgucauuaccuacgaaaauaacacauggguuaaucagaccuaugugaacaucucuaauacaaacuuugcugccgggcagagcguggucuccgugaaacuggcgggaaauucuagccuuugcccuguuuccggcugggcuauuuacagcaaggacaacucuaucagaaucggguccaaaggagauguguucgucauucgggagccguuuaucagcuguucuccccuggaaugccgcaccuucuuucucacacagggcgcccugcuuaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcucaccaucggcaucuccgggccugauaacggagcuguggccguccugaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccucgaauaucagaugggauacaucuguucuggcauuuucggggauaauccucgccccaacgacaaaaccggauccugcggcccggucagcucuaauggggccaacggagugaagggcuuuuccuucaaguauggcaacgggguuuggaucggaagaacaaaaagcauuuccucucggaauggcuuugagaugaucugggauccuaacggguggaccggaaccgacaauaacuucagcauuaagcaagacaucgugggcaucaaugaaugguccggguacucuggcagcuucguccagcaucccgagcugacaggacuugauuguauucgcccuugcuuuuggguggaacugaucagaggccggcccaaagagaacacgauuuggaccuccgggagcucuaucuccuucuguggaguuaauagcgacacagugggcuggucuuggcccgauggggcugagcucccuuuuaccauugacaaguga

SEQ ID NO: 202122 - RNA, 1410 nt, Artificial Sequence
  derived and/or modified sequence opt5 from neuraminidase__InfluenzaA__ADK33774
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuguuggaaauucuagccugugcccuguguccggcugggcgauuuacagcaaggacaacucuaucagaaucggguccaaaggagaugucuuugugauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggagguuccuucccccuacaacagccgcuuugaauccguggcuuggucugccagcgcuugccacgacggaauuaauuggcugaccaucggcaucuccgggccugauaacggagccgucgcugugcugaaguauaauggcauuaucacagacaccauuaagagcuggagaaacaauauccuccggacacaagagucugagugugccugcgugaacggguccuguuucaccgucaugacggauggaccgagcgacggccaggcgucuuacaaaauuuuucgcaucgaaaagggcaaaaucguuaagagcguggagaugaaugcccccaacuaucauuacgaagagugcuccuguuacccugauucuagcgagauuacaugcgugugcagagacaauuggcacggguccaaccggcccugggucagcuucaaucagaaccuggaauaucagaugggauacaucuguucuggcauuuuuggggauaauccucgccccaacgacaaaaccggauccugcggcccggugagcucuaauggggcuaacggaguuaagggcuucuccuuuaaguauggcaacgggguguggaucggaagaacaaaaagcauuuccucucggaauggcuucgagaugaucugggauccuaacggguggaccggaaccgacaauaacuuuagcauuaagcaagacaucgucggcaucaaugaaugguccggguacucuggcagcuucgugcagcaucccgagcuuacaggacuggauuguauucgcccuugcuucuggguugaacucaucagaggccggcccaaagagaacacgauuuggaccuccgggagcucuaucuccuuuuguggagugaauagcgacacagucggcuggucuuggcccgauggggccgagcugccuuucaccauugacaaguga

SEQ ID NO: 202123 - RNA, 1410 nt, Artificial Sequence; identical to SEQ ID NO: 200736
  derived and/or modified sequence opt5 from neuraminidase__InfluenzaA__ADK33784

SEQ ID NO: 202124 - RNA, 1410 nt, Artificial Sequence; identical to SEQ ID NO: 199762
  derived and/or modified sequence opt5 from neuraminidase__InfluenzaA__ADK33794

SEQ ID NO: 202125 - RNA, 1410 nt, Artificial Sequence; identical to SEQ ID NO: 199762
  derived and/or modified sequence opt5 from neuraminidase__InfluenzaA__ADK33804

SEQ ID NO: 202126 - RNA, 1410 nt, Artificial Sequence
  derived and/or modified sequence opt5 from neuraminidase__InfluenzaA__ADK33814
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaauaaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaugggauacaucuguucuggcauuuuuggggauaauccucgccccaacgacaagaccggauccugcggcccggucagcucuaauggggccaacggagugaagggcuucuccuuuaaauauggcaacgggguuuggaucggaagaacaaagagcauuuccucucggaauggcuucgagaugaucugggauccuaacggguggaccggaaccgacaauaacuuuagcauuaaacaggacaucgugggcaucaaugaaugguccggguacucuggcagcuucguccaacaucccgagcuuacaggacuggauuguauucgcccuugcuucuggguggaacucaucagaggccggcccaaggagaacacgauuuggaccuccgggagcucuaucuccuuuuguggaguuaauagcgacacagugggcuggucuuggcccgauggggcugagcugccuuucaccauugacaaauga

SEQ ID NO: 202127 - RNA, 1410 nt, Artificial Sequence
  derived and/or modified sequence opt5 from neuraminidase__InfluenzaA__ADK33824
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuauaucaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 202128 - RNA, 1410 nt, Artificial Sequence; identical to SEQ ID NO: 200939
  derived and/or modified sequence opt5 from neuraminidase__InfluenzaA__ADK33834

SEQ ID NO: 202129 - RNA, 1410 nt, Artificial Sequence
  derived and/or modified sequence opt5 from neuraminidase__InfluenzaA__ADK33844
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgcgaaacuugcuggaaauucuccucugugcccggugagcggcugggccauuuacuccaaggacaacagcaucagaaucgggucuaaaggagauguuuuugugauucgggagcccuucaucuccuguagcccucucgaaugccgcaccuuuuuccugacacagggcgcccuucugaaugacaagcauucuaacggcaccauuaaagauagaucccccuaucggacgcucaugagcuguccuaucggggagguccccucuccuuacaacucccgcuuugaaagcguggcuugguccgccucugcuugccacgacggaauuaauuggcugaccaucggcaucagcgggccggauaacggagccguugcggugcugaaguauaauggcauuaucacagacaccauuaaguccuggagaaacaauauccuccggacacaagagagcgagugugccugcgucaacgggucuuguuucaccgugaugacggauggacccuccgacggccaggcuagcuacaaaauuuuucgcaucgaaaagggcaaaaucgugaagucugucgagaugaaugccccuaacuaucauuacgaagagugcagcuguuaccccgauuccucugagauuacaugcguuugcagagacaauuggcacgggagcaaccggccuuggguguccuucaaucagaaccuggaauaucagaucggauacauuuguagcggcaucuuuggggauaauccccgcccgaacgacaaaaccggaucuugcggcccuguguccagcaauggggcuaacggagucaagggcuucucuuuuaaguauggcaacgggguguggauuggaagaacaaaauccaucagcucccggaauggcuucgagaugauuugggaucccaacggguggaccggaaccgacaauaacuuuucuaucaagcaagacaucguuggcauuaaugaauggagcggguacuccggcucuuucgugcagcauccugagcuuacaggacuggauuguauccgccccugcuucugggucgaacucauuagaggccggcccaaagagaacacgaucuggaccagcggguccagcauuucuuuuuguggaguuaauuccgacacagugggcuggagcuggccugauggggccgagcugccguucaccaucgacaaguga

SEQ ID NO: 202130 - RNA, 1410 nt, Artificial Sequence; identical to SEQ ID NO: 200939
  derived and/or modified sequence opt5 from neuraminidase__InfluenzaA__ADK33854

SEQ ID NO: 202131 - RNA, 1410 nt, Artificial Sequence; identical to SEQ ID NO: 201653
  derived and/or modified sequence opt5 from neuraminidase__InfluenzaA__ADK33864

SEQ ID NO: 202132 - RNA, 1410 nt, Artificial Sequence
  derived and/or modified sequence opt5 from neuraminidase__InfluenzaA__ADK33874
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauaccuuuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcugacaggacucgauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcuuccuuucaccauugacaaguga

SEQ ID NO: 202133 - RNA, 1410 nt, Artificial Sequence; identical to SEQ ID NO: 199762
  derived and/or modified sequence opt5 from neuraminidase__InfluenzaA__ADK33884

SEQ ID NO: 202134 - RNA, 1410 nt, Artificial Sequence; identical to SEQ ID NO: 200939
  derived and/or modified sequence opt5 from neuraminidase__InfluenzaA__ADK33894

SEQ ID NO: 202135 - RNA, 1410 nt, Artificial Sequence; identical to SEQ ID NO: 200939
  derived and/or modified sequence opt5 from neuraminidase__InfluenzaA__ADK33904

SEQ ID NO: 202136 - RNA, 1410 nt, Artificial Sequence; identical to SEQ ID NO: 201719
  derived and/or modified sequence opt5 from neuraminidase__InfluenzaA__ADK33914

SEQ ID NO: 202137 - RNA, 1410 nt, Artificial Sequence
  derived and/or modified sequence opt5 from neuraminidase__InfluenzaA__ADK33924
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcaacacagugggcuggucuuggcccgacggggcugagcugccuuucaccaucgauaaguga

SEQ ID NO: 202138 - RNA, 1410 nt, Artificial Sequence; identical to SEQ ID NO: 199762
  derived and/or modified sequence opt5 from neuraminidase__InfluenzaA__ADK33934

SEQ ID NO: 202139 - RNA, 1410 nt, Artificial Sequence; identical to SEQ ID NO: 199762
  derived and/or modified sequence opt5 from neuraminidase__InfluenzaA__ADK33944

SEQ ID NO: 202140 - RNA, 1410 nt, Artificial Sequence; identical to SEQ ID NO: 201719
  derived and/or modified sequence opt5 from neuraminidase__InfluenzaA__ADK33954

SEQ ID NO: 202141 - RNA, 1410 nt, Artificial Sequence; identical to SEQ ID NO: 199762
  derived and/or modified sequence opt5 from neuraminidase__InfluenzaA__ADK33964

SEQ ID NO: 202142 - RNA, 1410 nt, Artificial Sequence; identical to SEQ ID NO: 200869
  derived and/or modified sequence opt5 from neuraminidase__InfluenzaA__ADK33974

SEQ ID NO: 202143 - RNA, 1410 nt, Artificial Sequence; identical to SEQ ID NO: 199762
  derived and/or modified sequence opt5 from neuraminidase__InfluenzaA__ADK33984

SEQ ID NO: 202144 - RNA, 1410 nt, Artificial Sequence
  derived and/or modified sequence opt5 from neuraminidase__InfluenzaA__ADK39016
augaaccccaaucagaagaucauuaccaucggcagcgugugcauuacaaucgggauggccaaccugauucuccaaaucggaaauaucauuuccaucuggauuucucacagcauccagcugggcaaccagaaucagauugagacguguaaccaauccgucaucaccuacgaaaauaacacauggguuaaucagaccuaugugaacauuucuaauacaaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggugccuucccccuacaacagccgcuuugaauccguugccuggucugcuagcgccugccacgacggaaucuccuggcugaccaucggcauuagcgggccugauaauggagcuguggccguccugaaguauaacggcaucauuacagacaccaucaagucuuggagaaauaacauucuccggacacaagaguccgagugugcgugcgugaaugggagcuguuucaccgugaugacggauggaccgucugacggccaggccagcuacaaaaucuuucgcaucgaaaagggcaaaauugucaaguccguugagaugaacgcucccaauuaucauuacgaagagugcucuuguuacccugauagcuccgagaucacaugcgugugcagagacaacuggcacgggagcaaucggcccugggugucuuucaaccagaaucuggaauaucagauuggauacaucuguuccggcauuuuuggggauaacccucgccccaaugacaaaaccggaagcugcggcccggucucuuccaacggggccaauggagugaagggcuucagcuuuaaguauggcaacgggguuuggaucggaagaacaaaauccauuucuagccggaacggcuucgagaugaucugggauccugacggguggaccggaaccgacaauaacuuuuccaucaagcaagauauugugggcaucaaugaauggucuggguacagcggcuccuucguccagcaucccgagcuuacaggacuggacuguauucgcccuugcuucuggguggaacucaucagaggccggcccaaagagaacacgauuuggaccagcgggucuuccaucagcuuuuguggaguuaauucugauacagugggcugguccuggcccgacggggcugagcugccuuucaccaucgauaaguga

SEQ ID NO: 202145 - RNA, 1410 nt, Artificial Sequence; identical to SEQ ID NO: 199623
  derived and/or modified sequence opt5 from neuraminidase__InfluenzaA__ADK45315

SEQ ID NO: 202146 - RNA, 1410 nt, Artificial Sequence
  derived and/or modified sequence opt5 from neuraminidase__InfluenzaA__ADK45413
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuaugaacccacaauuaucgagagaaauauuaccgaaaucguguaccugacaaacaccacgauugagaaggaaaucuguccuaaacucgcugaguaucggaauugguccaagccccagugcgacauuaccggguucgccccuuuuucuaaagauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugaacugggcgugcccuuucaccucgggaccaagcaggucuguauugccugguccucuagcuccugccaugacggaaaagccuggcugcacguguguaucacaggcgaugacaagaacgcuaccgccagcuucauuuauaauggccggcuuguugauucuguggucuccuggagcaaagacauccugcgcacccaggagucugaaugcguguguauuaacgggacaugcacgguggucaugaccgauggauccgcuagcggcaaggccgacacaaaaauccucuuuaucgaggaggggaagauuguucauaccuccacacugucuggaagcgcgcaacacguggaagaguguuccugcuacccuagauaccccggcgugcggugcgucugucgcgauaacuggaaggggagcaauagaccuaucguggacauuaacaucaaagaccacucuauugccuccagcuauguuugcucuggacuugugggcgauacgccccggaagaaugacagcuccucuagcucccauugucuggauccgaacaaugaagagggcgggcacggagucaaaggcugggcuuucgacgaugggaacgacguguggaugggacgcaccaucagcgaaaagucuagacucggcuacgagacauuuaaaguuaucgaggggugguccaauccuaagagcaaacugcagauuaaccgccaggugaucgucgaucggggaaauagaucuggcuauuccggcauuuucagcguggaagggaaguccugcaucaaccgguguuuuuacgucgagcugauuagaggacgcaaggaagagaccgaagugcucuggaccucuaauagcaucguuguguucugcggcacauccgggaccuauggaacaggcucuuggcccgacggggccaacauuaaucugaugccuaucuga

SEQ ID NO: 202147 - RNA, 1410 nt, Artificial Sequence
  derived and/or modified sequence opt5 from neuraminidase__InfluenzaA__ADK45424
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuaccuuuguucuggacuggugggcgacacgccccggaagaaugauagcuccucuagcucccauugccucgacccgaacaaugaggaaggcgggcacggagucaaaggcugggccuucgaugacgggaacgauguguggaugggacgcaccaucagcgagaagucuagacugggcuaugagacauuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacucauuagaggacgcaaggaggaaaccgaggugcuguggaccucuaauagcaucguuguguucuguggcacauccgggaccuacggaacaggcucuuggcccgauggggcugacauuaaccuuaugccuaucuga

SEQ ID NO: 202148 - RNA, 1410 nt, Artificial Sequence; identical to SEQ ID NO: 200929
  derived and/or modified sequence opt5 from neuraminidase__InfluenzaA__ADK45446

SEQ ID NO: 202149 - RNA, 1410 nt, Artificial Sequence
  derived and/or modified sequence opt5 from neuraminidase__InfluenzaA__ADK45457
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccggcucuagccauugccuggacccgaacaaugaggaagggggacacggcgugaaagggugggccuucgaugacggaaacgauguuuggaugggccgcaccaucuccgagaagucuagacucggguaugagacauuuaaagugaucgaaggauggucuaauccuaaguccaaacugcagauuaaccggcaggucaucguggaccgcggcaauagaagcggcuacucugggauuuucuccgucgagggaaagagcuguaucaaccggugcuuuuauguggaacugauuagaggccgcaaggaggaaaccgagguucucuggaccuccaauucuaucguggucuucugugggacaagcggaaccuacggcacaggguccuggcccgauggcgcugacauuaaccugaugccuaucuga

SEQ ID NO: 202150 - RNA, 1410 nt, Artificial Sequence
  derived and/or modified sequence opt5 from neuraminidase__InfluenzaA__ADK45479
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagguugugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuagcgaaaagucuagacucggcuaugagacauuuaaagucaucgaggggugguccaaucauaagagcaaacugcagaucaaccgccaggugauugucgaucggggaaauagaucuggcuacuccggcaucuucagcguggaagggaaguccuguauuaaccggugcuuuuauguugagcugaucagaggacgcaaggaagaggcugaagugcucuggaccucuaauagcauugucguguucuguggcaccuccgggacauacggaaccggcucuuggccugacggggccgaucugaaccuuaugcccaucuga

SEQ ID NO: 202151 - RNA, 1410 nt, Artificial Sequence; identical to SEQ ID NO: 199762
  derived and/or modified sequence opt5 from neuraminidase__InfluenzaA__ADK48799

SEQ ID NO: 202152 - RNA, 1410 nt, Artificial Sequence; identical to SEQ ID NO: 201675
  derived and/or modified sequence opt5 from neuraminidase__InfluenzaA__ADK62686

SEQ ID NO: 202153 - RNA, 1410 nt, Artificial Sequence; identical to SEQ ID NO: 201113
  derived and/or modified sequence opt5 from neuraminidase__InfluenzaA__ADK62696

SEQ ID NO: 202154 - RNA, 1410 nt, Artificial Sequence; identical to SEQ ID NO: 200345
  derived and/or modified sequence opt5 from neuraminidase__InfluenzaA__ADK64994

SEQ ID NO: 202155 - RNA, 1410 nt, Artificial Sequence
  derived and/or modified sequence opt5 from neuraminidase__InfluenzaA__ADK65002
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaccggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccggccugaaguauaaugggaucauuaccgacacaaucaagagcuggagaaacaauauucuccggacccaagagucugagugugcgugcgucaacggauccuguuucacggugaugacagauggcccgagcgacggccaggccucuuacaaaaucuuucgcauugaaaaggggaaaaucgucaagagcguggagaugaaugcucccaacuaucauuacgaagagugcuccuguuacccugauucuagcgagauuaccugcguuugcagagacaauuggcacggauccaaccggcccugggugagcuucaaucagaaccuggaauaucagaucggcuacaucuguucugggauuuuuggagauaauccucgccccaacgacaaaacaggcuccugcgggccggugagcucuaauggagccaacggcgucaagggcuucuccuuuaaguaugggaacggaguguggaucggcagaaccaaaagcauuuccucucggaauggguucgagaugaucugggauccuaacggauggaccggcacagacaauaacuuuagcauuaagcaagacaucguugggaucaaugaaugguccggcuacucuggcagcuucgugcagcaucccgagcuuacgggacuggauuguauucgcccuugcuucugggucgaacucaucagagggcggcccaaagagaacaccauuuggacauccggaagcucuaucuccuuuuguggcgugaauagcgacaccguuggguggucuuggcccgauggagcugagcugccuuucacaauugacaaguga

SEQ ID NO: 202156 - RNA, 1410 nt, Artificial Sequence; identical to SEQ ID NO: 199762
  derived and/or modified sequence opt5 from neuraminidase__InfluenzaA__ADK65010

SEQ ID NO: 202157 - RNA, 1410 nt, Artificial Sequence
  derived and/or modified sequence opt5 from neuraminidase__InfluenzaA__ADK65018
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggccugcuucugccugccacgacggaauuaauuggcugaccaucggcaucagcgggccggauaacggagcuguggccguccugaaguauaauggcauuaucacagacaccauuaaguccuggagaaacaauauccuccggacacaagagagcgagugugcgugcgugaacgggucuuguuucaccauuaugacggauggacccuccgacggccaggccagcuacaaaaucuuucgcaucgaaaagggcaaaauugugaagucuaucgagaugaaugcuccuaacuaucauuacgaagagugcagcuguuaccccgauuccucugagauuacaugcgucugcagagacaauuggcacgggagcaaccggccuuggguuuccuucaaucagaaccuggaauaucagaucggauacauuuguagcggcaucuuuggggauaauccccgcccgaacgacaaaaccggaucuugcggcccuguguccagcaauggggccaacggagugaagggcuucucuuuuaaguauggcaacggggucuggauuggaagaacaaaauccaucagcucccggaauggcuucgagaugaucugggaucccaacggguggaccggaaccgacaauaacuuuucuauuaagcaagacaucgugggcauuaaugaauggagcggguacuccggcucuuucguucagcauccugagcuuacaggacuggauuguauccgccccugcuucuggguggaacucauuagaggccggcccaaagagaacacgaucuggaccagcggguccagcaucucuuuuuguggagucaauuccgacacagugggcuggagcuggccugauggggcugagcugccguucaccauugacaaguga

SEQ ID NO: 202158 - RNA, 1410 nt, Artificial Sequence
  derived and/or modified sequence opt5 from neuraminidase__InfluenzaA__ADK87290
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccuauacaaaaauccucuuuaucgaggaagggaagauuguucauaccuccacacugucuggaagcgcgcaacacguggaggaaugcuccugcuacccuagauaccccggcgugcggugugucugccgcgauaacuggaaggggagcaauagaccuaucguggacauuaacaucaaagaucacucuauuguuuccagcuauguguguucuggacuugucggcgacacgccccggaagaaugacagcuccucuagcucccauugccuggauccgaacaaugaggaaggcgggcacggagugaaaggcugggccuucgacgaugggaacgacguuuggaugggacgcaccaucagcgagaagucuagacucggcuacgagacauuuaaagugaucgaagggugguccaauccuaagagcaaacugcagauuaaccggcaggucaucguggaucgcggaaauagaucuggcuauuccggcauuuucagcgucgaggggaaguccuguaucaaccggugcuuuuacguggaacugauuagaggacgcaaggaggaaaccgagguucucuggaccucuaauagcaucguggucuucuguggcacauccgggaccuauggaacaggcucuuggcccgacggggcugauauuaaccugaugccuguguga

SEQ ID NO: 202159 - RNA, 1410 nt, Artificial Sequence
  derived and/or modified sequence opt5 from neuraminidase__InfluenzaA__ADK87292
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacgccuguucuggacuugugggcgacacgccccggaagaaugauagcuccucuagcucccauugccuggacccgaacaaugaggaaggcgggcacggagucaaaggcugggcuuucgaugacgggaacgauguguggaugggacgcaccaucagcgagaagucuagacucggcuaugagacauuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacugauuagaggacgcaaggaggaaaccgaggugcucuggaccucuaauagcaucguuguguucuguggcacauccgggaccuacggaacaggcucuuggcccgauggggccgacauuaaccugaugccugucuga

SEQ ID NO: 202160 - RNA, 1410 nt, Artificial Sequence
  derived and/or modified sequence opt5 from neuraminidase__InfluenzaA__ADK87294
augaaccccaaucagaagaucauugccaucggcagcgugucccugaccauuucuacaaucugcuucuuucuccaaauugcuauccugaucacgaccgucacacuucacuucaaacaguacgaguuuaacagcccuccgaauaaccagguuaugcugugugaacccaccauuaucgagagaaauauuacagaaaucguguaucucaccaacacaaccauugagaaggaaaucugcccuaaacuggccgaguaccggaauugguccaagccccagugugacauuacgggguucgcgccuuuuucuaaagauaacagcauccgccuuuccgcuggaggcgacaucugggugaccagagagcccuaugucucuugcgauccugacaaguguuaccaauucgcccuggggcagggaacaacccucaauaacgugcauagcaauaacacaguucgggaucgcaccccguauagaacgcugcugaugaaugaacucggcgugcccuuucaccuggggacaaagcaggucugcauugccugguccucuagcuccugucgggacggaaaggcuuggcuucaugugugcaucaccggcgaugacaaaaacgccacagcuagcuucauuuacaauggccgccugguugauucuguggucuccuggagcaaagagauccucagaacccaggaaucugagugugugugcauuaacgggaccuguacaguggucaugacggacggauccgccagcggcaaggcggauaccaaaauccuguuuaucgaggaagggaagauuguucacacauccacccuuucuggaagcgcccaacauguggaggaaugcuccugcuauccucgguaccccggcgugcgcugugucugcagagacacagggaagggaagcaaccggccuaucguggauauuaauaucaaagaccacucuauuguuuccagcuacguguguucuggccuggucggcgacacgccccgcaagaacgauagcuccucuagcucccacugccucgacccgaauaacgaggaagggggacauggcgugaaagggugggcuuucgaugacggaaaugauguuuggaugggcagaaccaucagcgagaagucucggcugggguaugagacauuuaaagugaucgaaggaugguccaacccuaagagcaaacugcagauuaaucgccaggucaucguggacagaggcaaccggucuggcuacuccgggauuuucagcgucgagggaaaguccuguaucaauagaugcuuuuauguggaacucauucgcggccggaaggaggaaaccgagguucuguggaccucuaacaauaucguggucuucugugggacaagcggaaccuacggcacaggguccuggcccgauggcgccgacauuaaccuuaugccuguguga

SEQ ID NO: 202161 - RNA, 1410 nt, Artificial Sequence
  derived and/or modified sequence opt5 from neuraminidase__InfluenzaA__ADK87297
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaaaacagaagcccuuaucggacgcucaugucuugucccaucggggaggugccuucccccuacaauagccgcuuugaauccguugccuggucugcuagcgccugccacgauggaauuaacuggcugaccaucggcaucuccgggccugacaauggagcuguggccguccugaaguauaacggcauuaucacagauaccauuaagagcuggagaaauaacauccuccggacacaagagucugagugugcgugcgugaauggguccuguuucaccgugaugacggacggaccgagcgauggccaggccucuuacaaaauuuuucgcaucgaaaagggcaaaaucgucaagagcguugagaugaacgcucccaauuaucauuacgaagagugcuccuguuacccugacucuagcgagauuacaugcgugugcagagauaacuggcacggguccaaucggcccugggugagcuucaaccagaaucuggaauaucagaucggauacauuuguucuggcaucuuuggggacaacccucgccccaaugauaaaaccggauccugcggcccggucagcucuaacggggccaacggagugaagggcuucuccuuuaaguauggcaaugggguuuggauuggaagaacaaaaagcaucuccucucggaacggcuucgagaugauuugggacccuaauggguggaccggaaccgauaacaauuuuagcaucaagcaagacaucgugggcauuaacgaaugguccggguacucuggcagcuucguccagcaucccgagcuuacaggacuggacuguauccgcccuugcuucuggguggaacucauuagaggccggcccaaagagaauacgaucuggaccuccgggagcucuauuuccuuuuguggaguuaacagcgauacagugggcuggucuuggcccgacggggcugagcugccuuucaccaucgauaaguga

SEQ ID NO: 202162 - RNA, 1410 nt, Artificial Sequence
  derived and/or modified sequence opt5 from neuraminidase__InfluenzaA__ADK87299
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuuuaaaauuuuccgcaucgaaaagggcaaaaucgucaagagcguugagaugaaugcucccaacuaccauuaugaagagugcuccuguuacccugauucuagcgagauuacaugcgugugcagagacaauuggcacggguccaaccggcccugggugagcuuuaaucagaaccuggaauaccagaucggauauauuuguucuggcaucuucggggauaauccucgccccaacgacaaaaccggauccugcggcccggucagcucuaauggggccaacggagugaagggcuuuuccuucaaguacggcaacgggguuuggauuggaagaacaaaaagcaucuccucucggaauggcuuugagaugauuugggauccuaacggguggaccggaaccgacaauaacuucagcaucaagcaagacaucgugggcauuaaugaaugguccggguauucuggcagcuucguccagcaucccgagcuuacaggacuggauuguauccgcccuugcuuuuggguggaacucauuagaggccggcccaaagagaacacgaucuggaccuccgggagcucuauuuccuucuguggaguuaauagcgacacagugggcuggucuuggcccgauggggcugagcugccuuuuaccaucgacaaguga

SEQ ID NO: 202163 - RNA, 1410 nt, Artificial Sequence
  derived and/or modified sequence opt5 from neuraminidase__InfluenzaA__ADK87301
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggcuaugaccgacggauccgccagcggcaaggcggauacaaaaauccucuuuaucgaggaagggaagauuguccauaccuccacacugucuggaagcgcccaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggcuuucgaugacgggaacgauguguggaugggacgcaccaucagcgagaagucuagacucggcuaugagacauuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacugauuagaggacgcaaggaggaaaccgaggugcucuggaccucuaauagcaucguuguguucuguggcacauccgggaccuacggaacaggcucuuggcccgauggggccgacauuaaccugaugccuaucuga

SEQ ID NO: 202164 - RNA, 1410 nt, Artificial Sequence; identical to SEQ ID NO: 199623
  derived and/or modified sequence opt5 from neuraminidase__InfluenzaA__ADK87303

SEQ ID NO: 202165 - RNA, 1410 nt, Artificial Sequence
  derived and/or modified sequence opt5 from neuraminidase__InfluenzaA__ADK87305
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucgugggacgcggcaauagaucuggcuacuccgggauuuucagcgucgagggaaaguccuguaucaaccggugcuuuuauguggaacugauuagaggccgcaaggaggaaaccgagguucucuggaccucuaauagcaucguggucuucugugggacauccggaaccuacggcacagggucuuggcccgacggcgcugauauuaaccugaugccuguguga

SEQ ID NO: 202166 - RNA, 1410 nt, Artificial Sequence
  derived and/or modified sequence opt5 from neuraminidase__InfluenzaA__ADK87307
augaaccccaaucagaaggugaucaccauuggcagcgucucccugacaaucucuacgauuugcuucuuuaugcaaaucgccauucucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugagacauuuaaagucaucgaagggugguccaauccuaagagcaaacugcagaucaaccgccaggugauugucggacggggcaauagaucuggcuacuccgggaucuucagcguggagggaaaguccuguauuaaccggugcuuuuauguugaacugaucggcgggagaaaggaggaaaccgaggugcucuggaccucuaauagcauugucguguucuguggaacauccggcaccuacgggacaggcucuuggcccgacggagcugauaucaaccugaugccuguuuga

SEQ ID NO: 202167 - RNA, 1410 nt, Artificial Sequence
  derived and/or modified sequence opt5 from neuraminidase__InfluenzaA__ADK87312
augaaccccaaucagaccaucauuacaaucggcagcgugugcaugacgauugggauggccaaccugauccuccaaauuggaaauaucaucuccauuuggaucucucacagcauucagcugggcaaccagaaucagaucgagaccuguaaccaauccgucauuacauacgaaaauaacaccuggguuaaucagacauaugugaacaucucuaauaccaacuucgcugccgggcagagcgugauuuccgucaaacuugcgggaaauucuagccugugcccuguguccggcugggcuaucuacagcaaggacaacaauaucagaauugggucuaagggagauguuuuugugauccgggagccguucauuuccuguagcccccucgaaugccgcacauuuuuccugacccagggcgcccuucugaacgacaaacauucuaacggcacgaucaaggauagauccccuuaucggacccucaugagcugucccauuggggaggucccuucucccuacaauucccgcuuugaaagcguggccugguccgcuucugccugccacgacggaaucaacuggcugacaaucggcauuagcgggccugauaauggagcuguugccgugcugaaauauaacggcaucauuaccgacacaaucaaguccuggagaaauaacauucuccggacccaagagagcgagugugcgugcgucaaugggucuuguuucacggugaugacagauggaccguccgacggccaggccagcuacaagaucuuucgcaucgaaaaaggcaagauugugaaaucugucgagaugaacgcucccaauuaucauuacgaagagugcagcuguuacccugauuccucugagauuaccugcguuugcagagacaacuggcacgggagcaaucggcccuggguguccuucaaccagaaucuggaauaucagaucggauacaucuguagcggcauuuuuggggauaacccucgccccaaugacaagacaggaucuugcggcccgguguccagcaacggggccaacggagucaaaggcuucucuuuuaaguauggcaaugggguguggaucggaagaaccaaguccauuagcucccggaacggcuucgagaugaucugggauccuaauggguggaccggaacagacaacaauuuuucuaucaaacaagacauuguuggcaucaacgaauggagcggguacuccggcucuuucgugcagcaucccgagcuuacgggacuggauuguauucgcccuugcuucugggucgaacucaucagaggccggcccaaggagaauaccauuuggacaagcggguccagcaucucuuuuuguggagugaacuccgacaccguuggcuggagcuggcccgauggggcugagcugccuuucacaaucgacaaauga

SEQ ID NO: 202168 - RNA, 1410 nt, Artificial Sequence
  derived and/or modified sequence opt5 from neuraminidase__InfluenzaA__ADK87314
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgaggggaauauuaccgaaaucguguaucugacaaacaccacgauugagaaggaaaugugcccuaaacucgcugaguacagaaauugguccaagccccagugugacaucaccggauucgccccuuuuucuaaagauaacagcauucggcuguccgcgggcggggacaucugggugacacgcgagcccuaugucucuugcgauccugacaaguguuaccaauucgcucuuggacagggcaccacacugaauaacgugcauagcaauaacaccguuagagaucggacgccguaucgcacacuccugaugaaugaacugggggugcccuuucaccucggaaccaagcaggucugcaucgccugguccucuagcuccugucaugacggcaaagccuggcugcacgugugcauuacaggcgaugacaagaacgcuaccgccagcuucaucuacaaugggagacuuguugauucuguggucuccuggagcaaagagauucugcggacccaggaaucugagugugugugcaucaacggaacauguacgguggucaugaccgacggcuccgcuagcgggaaggccgauacaaaaauucucuuuaucgaggaaggaaagaucguucauaccuccacaucuagcggcuccgcgcaacacguggaggaaugcagcugcuauccucgcuaccccggggugagaugugucugccgggacaacuggaagggaucuaaucgcccuauuguggauaucaacauuaaagaccacuccaucguuagcucuuacguguguagcggccuggucggcgacacccccagaaagaaugauuccucuagcuccagccauugccuugacccgaacaaugaggaagggggacacggcgugaaagggugggccuucgaugacggaaacgauguuuggaugggccggacgauuucugagaagucccgccugggguaugagacauuuaaagugaucgaaggauggagcaauccuaagucuaaacuccagaucaacagacaggucauuguggaccggggcaaucgcuccggcuacagcgggaucuucuccgucgagggaaagucuuguauuaacagaugcuuuuauguggaacugauccggggcagaaaggaggaaaccgagguucuguggaccagcaauuccauuguggucuucugugggacaucuggaaccuacggcacagggagcuggcccgauggcgcugacaucaaccucaugccuguguga

SEQ ID NO: 202169 - RNA, 1410 nt, Artificial Sequence
  derived and/or modified sequence opt5 from neuraminidase__InfluenzaA__ADK87316
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagaucacaggacuugauuguauucgcccuugcuucuggguggaacugaucagaggccggcccaaagagaacacgauuuggaccuccgggagcucuaucuccuuuuguggaguuaauagcgacacagugggcuggucuuggcccgauggggcugagcucccuuucaccaucgacaaguga

SEQ ID NO: 202170 - RNA, 1410 nt, Artificial Sequence
  derived and/or modified sequence opt5 from neuraminidase__InfluenzaA__ADK87318
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuccuggguggaacucauuagaggccggcccaaagagaacacgaucuggaccagcgggucuuccaccagcuucuguggaguuaauucugacacagugggcugguccuggcccgauggggcugagcugccuuuuacaauugacaaguga

SEQ ID NO: 202171 - RNA, 1410 nt, Artificial Sequence
  derived and/or modified sequence opt5 from neuraminidase__InfluenzaA__ADK87320
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguucaucagaccuaugugaauaucucuaacacaaauuucgcugccgggcagagcguggucuccgugaaacuugcgggaaacucuagccugugcccuguuuccggcugggcuauuuacagcaaggacaauucuaucagaaucggguccaaaggagauguguuugucauucgggagccguucaucagcuguucuccccucgaaugccgcaccuuuuuccugacacagggcgcccuucugaacgacaagcacuccaauggcaccauuaaagauagaagcccuuaucggacgcucaugucuugucccaucggggaggugccuucccccuacaacagccgcuuugaauccguugccuggucugcuagcgccugccaugacggaauuaacuggcugaccaucggcaucuccgggccugauaauggagcuguggccguccugaaguauaacggcauuaucacagacaccauuaagagcuggagaaauaacauccuccggacacaagagucugagugugcgugcgugaauggguccuguuucaccgugaugacggauggaccgagcgacggccaggccucuuacaaaauuuuucgcaucgaaaagggcaaaaucgucaagagcguugagaugaacgcucccaauuaucacuacgaagagugcuccuguuacccugauucuagcgagauuacaugcgugugcagagacaacuggcauggguccaaucggcccugggugagcuucaaccagaaucuggaauaucagaucggauacauuuguucuggcaucuuuggggauaacccucgccccaaugacaaaaccggauccugcggcccggucagcucuaacggggccaauggagugaagggcuucuccuuuaaguauggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguacucuggcagcuucguccagcaccccgagcuuacaggacugaauuguauccgcccuugcuucuggguggaacucauuagaggccggcccaaagagaacacgaucuggaccuccgggagcucuauuuccuuuuguggaguuaauagcgauacagugggcuggucuuggcccgacggggcugagcugccuuucaccaucgauaaguga

SEQ ID NO: 202172 - RNA, 1410 nt, Artificial Sequence
  derived and/or modified sequence opt5 from neuraminidase__InfluenzaA__ADK87324
augaaccccaaucagaagaucauuaccaucggcagcgugucccugacaauuucuacgaucugcuuccucaugcaaauugccauccugaucaccacagucacccuucacuuuaaacaguacgaguucaacagcccuccgaauaaccagguuaugcugugugaacccacaauuaucgagagaaauauuaccgaaaucguguaucucacaaacaccacgauugagaaggaaaucugcccuaaacuggcugaguaccggaauugguccaagccccagugugacauuaccggguuugccccuuucucuaaagauaacagcauccgccuuuccgcgggaggcgacaucugggugacaagagagcccuaugucucuugcgauccugggaaguguuaccaauuugcucugggacagggcaccacacucaauaacgugcauagcaauaacaccguucgggaccgcacgccguauagaacacugcugaugaaugaacucggggugcccuuccaccugggaaccaagcaggucugcauugccugguccucuagcuccugucaugauggcaaagccuggcuucacgugugcaucacaggcgacgaugagaacgcuaccgccagcuuuauuuacaaugggcggcugguugacucuguggucuccuggagcaaggaaauccuccgcacccaggagucugagugugugugcauuaacggaacauguacgguggucaugaccgauggcuccgcuagcgggaaagccgacacaaagauccuguucaucgaagagggaaaaauuguucauaccuccacacuuucuggcagcgcgcaacacguggaagagugcuccugcuauccuagauaccccggggugcggugugucugccgcgauaacuggaagggaagcaauagaccuaucguggacauuaacaucaaggaucacucuauuguuuccagcuacguguguucuggccuggucggcgacacgccccggaaaaaugacagcuccucuagcucccauugccucgauccgaacaaugaagaagggggacacggcgugaaggggugggccuuugacgauggaaacgacguuuggaugggccgcaccaucagcgagaaaucuagacugggguaugagacauucaaggugaucgagggaugguccaauccuaaaagcaagcugcagauuaaccggcaggucaucguggaucgcggcaauagaucuggcuacuccgggauuuuuagcgucgaaggaaaauccuguaucaaccggugcuucuauguggagcucauuagaggccgcaaggaagagaccgagguucuguggaccucuaauagcaucguggucuuuugugggacauccggaaccuacggcacagggucuuggcccgacggcgcugauauuaaccuuaugccuguguga

SEQ ID NO: 202173 - RNA, 1410 nt, Artificial Sequence
  derived and/or modified sequence opt5 from neuraminidase__InfluenzaA__ADK87327
augaaccccaaucagaagaucaugaccauuggcagcgugucccugacaaucucuacgauuugcuucuuuaugcaaaucgccauucucaucaccacagucacccugcacuucaaacaguacgaguuuaacagcccuccgaauaaccagguuaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcaucgccugguccucuagcuccugucaugacggaaaagccuggcugcacgugugcauuacaggcgaugacaagaacgcuaccgccagcuucaucuacaauggccggcuuguugauucuguggucuccuggagcaaagagauucugcgcacccaggaaucugagugugugugcaucaacgggacauguacgguggucaugaccgacggauccgcuagcggcaaggccgauacaaaaauucucuuuaucgaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccauuagcgagagaucucggcucggcuaugagacauuuaaggugaucgaagggugguccaauccuaaaagcaagcugcagaucaaccgccaggucauuguggacagaggaaaucggucuggcuacuccggcaucuucagcgucgaggggaaauccuguauuaacagaugcuuuuauguggaacugauccgcggacggaaggaggaaaccgagguucucuggaccucuaauagcauuguggucuucuguggcacauccgggaccuacggaacaggcucuuggcccgauggggcugacaucaaccugaugccuguguga

SEQ ID NO: 202174 - RNA, 1410 nt, Artificial Sequence; identical to SEQ ID NO: 199762
  derived and/or modified sequence opt5 from neuraminidase__InfluenzaA__ADK87329

SEQ ID NO: 202175 - RNA, 1410 nt, Artificial Sequence
  derived and/or modified sequence opt5 from neuraminidase__InfluenzaA__ADK87330
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucugggcuuccgggagcucuauuuccuuuuguggaguuaauagcgacaccgugggcuggucuuggcccgauggggccgagcugccuuucacaaucgacaaguga

SEQ ID NO: 202176 - RNA, 1410 nt, Artificial Sequence; identical to SEQ ID NO: 199762
  derived and/or modified sequence opt5 from neuraminidase__InfluenzaA__ADK87331

SEQ ID NO: 202177 - RNA, 1410 nt, Artificial Sequence
  derived and/or modified sequence opt5 from neuraminidase__InfluenzaA__ADK87332
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaagcauaauggcauuaucacagacaccauuaagagcuggagaaacaauauccuccggacacaagagucugagugugcgugcgugaacggguccuguuucaccgugaugacggauggaccgagcgacggccaggccucuuauaaaauuuuucgcaucgaaaagggcaaaaucgucaagagcguugagaugaaugcucccaacuaccacuaugaagagugcuccuguuacccugauucuagcgagauuacaugcgugugcagagacaauuggcauggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguauucuggcagcuucguccagcaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202178 - RNA, 1410 nt, Artificial Sequence
  derived and/or modified sequence opt5 from neuraminidase__InfluenzaA__ADK87333
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccuuauucuagcgagauuacaugcgugugcagagauaauuggcacggguccaaccggcccugggugagcuucaaucagaaccuggaauaccagaucggauauauuuguucuggcaucuuuggggacaauccucgccccaacgauaaaaccggauccugcggcccggucagcucuaauggggccaacggagugaagggcuucuccuuuaaguacggcaacgggguuuggauuggaagaacaaaaagcaucuccucucggaauggcuucgagaugauuugggacccuaacggguggaccggaaccgauaauaacuuuagcaucaagcaagacaucgugggcauuaaugaaugguccggguauucuggcagcuucguccagcaucccgagcuuacaggacuggacuguauccgcccuugcuucuggguggaacucauuagaggccggcccaaagagaacacgaucuggaccuccgggagcucuauuuccuuuuguggaguuaauagcgauacagugggcuggucuuggcccgacggggcugagcugccuuucaccaucgauaaguga

SEQ ID NO: 202179 - RNA, 1410 nt, Artificial Sequence
  derived and/or modified sequence opt5 from neuraminidase__InfluenzaA__ADK87335
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugaccggcgcuaccaauucgcucuugggcagggaaccacacugaauaacgugcauagcgauaauaccguuagagaccggacgccguaucgcacacuccugaugaacgaacugggcgugcccuuucaccucgggaccaagcaggucuguauugccugguccucuagcuccugccaugauggaaaggccuggcugcacguguguaucacaggcgacgauaaaaaugcuaccgccagcuucauuuacaacggcagacuuguugacucuguggucuccuggagcaaggagauccugcggacccaggaaucugagugcguguguauuaaugggacaugcacgguggucaugaccgauggauccgcuagcggcaaagccgacacaaagauccucuuuaucgaggaagggaaaauuguucauaccuccacacugucuggaaacgcgcaacacguggaggaauguagcugcuauccucgcuaccccggcgugagaugcgucugucgggauaacuggaagggguccaaucgcccuaucguggacauuaacaucaaggaccacagcauuguuucuuccuacgugugcagcggacuugucggcgauacccccagaaagaaugacucuagcuccucuagccauugucuggauccgaacaaugaggaaggcgggcacggagugaaaggcugggccuucgacgaugggaacgacguuuggaugggacggacgaucuccgagaaaagccgccucggcuaugagacauuuaaggugaucgaaggguggucuaauccuaaauccaagcugcagauuaacagacaggucaucguggaucggggaaauagaagcggcuacucuggcauuuucuccgucgaggggaaaagcugcaucaaccgcuguuuuuauguggaacugauucggggaagaaaggaggaaaccgagguucucuggaccuccaauucuaucguggucuucugcggcacaagcgggaccuacggaacaggcuccuggcccgacggggcugauauuaaccugaugccuaucuga

SEQ ID NO: 202180 - RNA, 1410 nt, Artificial Sequence
  derived and/or modified sequence opt5 from neuraminidase__InfluenzaA__ADK87337
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacgccguucgggaucgcaccccguauagaacgcuccugaugaaugaacugggcgugcccuuucaccucgggacaaagcaggucugcauugccugguccagcagcuccugucaugacggaaaggcuuggcugcacgugugcaucaccggcgaugacaagaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaaacgcccaacacguggaggaaugcagcugcuauccuagauaccccggcgugcggugugucugccgcgacaauuggaagggguccaacagaccuaucguggauauuaauaucaaagaccacagcauuguuucuuccuacguguguagcggacuugucggcgacacaccccggaagaacgauucuagcuccucuagccauugccuggacccgaauaacgaggaaggcgggcacggagugaaaggcugggcuuucgaugacgggaaugauguuuggaugggacgcaccaucuccgagaagucuagacucggcuaugagacguuuaaagugaucgaaggguggucuaacccuaaguccaaacugcagauuaaucggcaggucaucguggaccgcggaaacagaagcggcuacucuggcauuuucuccgucgaggggaaaagcuguaucaaucggugcuuuuauguggaacugauuagaggacgcaaggaggaaacagagguucucuggaccuccaacucuaucguggucuucuguggcaccagcgggacauacggaaccggcuccuggcccgauggggccgacauuaaucugaugccuaucuga

SEQ ID NO: 202181 - RNA, 1410 nt, Artificial Sequence
  derived and/or modified sequence opt5 from neuraminidase__InfluenzaA__ADK87339
augaaccccaaucagaagaucauuaccaucggcagcauuugcaugacaaucgggauggccaaccugauucuccaaaucggaaauaucauuuccaucuggauuucucacagcauccagcugggcaaccagaaucagauugagacguguaaccaauccgugaucaccuacgaaaauaacacaugggucaaucagaccuauguuaacauuucuaauacaaacuucgcugccgggcagagcgugguguccgucaaacuugcgggaaauucuagccugugcccuguguccggcugggcuaucuacagcaaggacaacucuaucagaauuggguccaaaggagauguuuuugugauccgggagccguucauuagcuguucuccccucgaaugccgcaccuuuuuccugacacagggcgcccuucugaaugacaagcauuccaacggcaccaucaaagauagaagcccuuaucggacgcucaugucuugucccauuggggaggucccuucccccuacaacagccgcuuugaauccguggccuggucugcuagcgccugccacgacggaaucaauuggcugaccaucggcauuuccgggccugauaacggagcuguugccgugcugaaguauaauggcaucauuacagacaccaucaagagcuggagaaacaauauucuccggacacaagagucugagugugcgugcgucaacggguccuguuucaccgugaugacggauggaccgagcgacggccaggccucuuacaaaaucuuucgcaucgaaaagggcaaaauugucaagagcguggagaugaaugcucccaacuaucauuacgaagagugcuccuguuacccugauucuagcgagaucacaugcguuugcagagacaauuggcacggguccaaccggcccugggugagcuucaaucagaaccuggaauaucagauuggauacaucuguucuggcauuuuuggggauaauccucgccccaacgacaaaaccggauccugcggcccggugagcucuaauggggccaacggagucaagggcuucuccuuuaaguauggcaacgggguguggaucggaagaacaaaaagcauuuccucucggaauggcuucgagaugaucugggauccuaacggguggaccggaaccgacaauaacuuuagcaucaagcaagacauuguuggcaucaaugaaugguccggguacucuggcagcuucgugcagcaucccgagcuuacaggacuggauuguauucgcccuugcuucugggucgaacucaucagaggccggcccaaagagaacacgauuuggaccuccgggagcucuaucuccuuuuguggagugaauagcgacacaguuggcuggucuuggcccgauggggcugagcugccuuucaccaucgacaaguga

SEQ ID NO: 202182 - RNA, 1410 nt, Artificial Sequence; identical to SEQ ID NO: 199762
  derived and/or modified sequence opt5 from neuraminidase__InfluenzaA__ADK90209

SEQ ID NO: 202183 - RNA, 1410 nt, Artificial Sequence; identical to SEQ ID NO: 199762
  derived and/or modified sequence opt5 from neuraminidase__InfluenzaA__ADK90213

SEQ ID NO: 202184 - RNA, 1410 nt, Artificial Sequence; identical to SEQ ID NO: 199762
  derived and/or modified sequence opt5 from neuraminidase__InfluenzaA__ADK90217

SEQ ID NO: 202185 - RNA, 1410 nt, Artificial Sequence; identical to SEQ ID NO: 201741
  derived and/or modified sequence opt5 from neuraminidase__InfluenzaA__ADK90221

SEQ ID NO: 202186 - RNA, 1410 nt, Artificial Sequence; identical to SEQ ID NO: 201741
  derived and/or modified sequence opt5 from neuraminidase__InfluenzaA__ADK90225

SEQ ID NO: 202187 - RNA, 1410 nt, Artificial Sequence; identical to SEQ ID NO: 199762
  derived and/or modified sequence opt5 from neuraminidase__InfluenzaA__ADK90229

SEQ ID NO: 202188 - RNA, 1410 nt, Artificial Sequence; identical to SEQ ID NO: 199762
  derived and/or modified sequence opt5 from neuraminidase__InfluenzaA__ADK90233

SEQ ID NO: 202189 - RNA, 1410 nt, Artificial Sequence
  derived and/or modified sequence opt5 from neuraminidase__InfluenzaA__ADK90241
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaaugcuaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccucaccggacccucaugucuugucccaucggggaggugccuucccccuauaacagccgcuuugaauccguugcuuggucugccagcgcuugccaugacggaauuaauuggcugacgaucggcaucuccgggccugauaacggagccguggcgguccugaaguacaauggcauuaucaccgacacaauuaagagcuggagaaacaauauccuccggacccaagagucugagugugccugcgugaacggguccuguuucacagugaugaccgauggaccgagcgacggccaggcuucuuauaaaauuuuucgcaucgaaaagggcaaaaucgucaagagcguugagaugaaugcccccaacuaccacuaugaagagugcuccuguuacccugauucuagcgagauuacgugcgugugcagagacaauuggcauggguccaaccggcccugggugagcuucaaucagaaccuggaauaccagaucggauauauuuguucuggcaucuuuggggauaauccucgccccaacgacaaaacaggauccugcggcccggucagcucuaauggggcuaacggagugaagggcuucuccuuuaaguacggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguauucuggcagcuucguccagcaccccgagcuuaccggacuggauuguauccgcccuugcuucuggguggaacucauuagaggccggcccaaagagaacacaaucuggacguccgggagcucuauuuccuuuuguggaguuaauagcgacaccgugggcuggucuuggcccgauggggccgagcugccuuucacaaucgacaaguga

SEQ ID NO: 202190 - RNA, 1410 nt, Artificial Sequence; identical to SEQ ID NO: 201741
  derived and/or modified sequence opt5 from neuraminidase__InfluenzaA__ADK90245

SEQ ID NO: 202191 - RNA, 1410 nt, Artificial Sequence
  derived and/or modified sequence opt5 from neuraminidase__InfluenzaA__ADK90249
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaugaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 202192 - RNA, 1410 nt, Artificial Sequence; identical to SEQ ID NO: 202191
  derived and/or modified sequence opt5 from neuraminidase__InfluenzaA__ADK90253

SEQ ID NO: 202193 - RNA, 1410 nt, Artificial Sequence
  derived and/or modified sequence opt5 from neuraminidase__InfluenzaA__ADK90257
augaaccccaaucagaagaucauuaucauuggcagcgugugcaugaccaucgggauggccaaccugauucuccaaaucggaaauaucauuuccaucuggauuucucacagcauccagcugggcaaccagaaucagauugagacauguaaccaauccgucaucacguacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuaucagaauuggguccaaaggagauguguuugucauccgggagccguucauuagcuguucuccccucgaaugccgcacauuuuuccugacccagggcgcccuucugaaugacaagcauuccaacggcacaaucaaagauagaagcccucaccggacccucaugucuugucccauuggggaggugccuucccccuauaacagccgcuuugaauccguugccuggucugcuagcgccugccaugacggaaucaauuggcugacgaucggcauuuccgggccugauaacggagcuguggccguccugaaguacaauggcaucauuaccgacacaaucaagagcuggagaaacaauauucuccggacccaagagucugagugugcgugcgugaacggguccuguuucacagugaugaccgauggaccgagcgacggccaggccucuuauaaaaucuuucgcaucgaaaagggcaaaauugucaagagcguugagaugaaugcucccaacuaccacuaugaagagugcuccuguuacccugauucuagcgagaucacgugcgugugcagagacaauuggcauggguccaaccggcccugggugagcuucaaucagaaccuggaauaccagauuggauauaucuguucuggcauuuuuggggauaauccucgccccaacgacaaaacaggauccugcggcccggucagcucuaauggggccaacggagugaagggcuucuccuuuaaguacggcaacgggguuuggaucggaagaaccaaaagcauuuccucucggaauggcuucgagaugaucugggauccuaacggguggacaggaaccgacaauaacuuuagcaucaagcaagacauugugggcaucaaugaaugguccggguauucuggcagcuucguccagcaccccgagcuuaccggacuggauuguauucgcccuugcuucuggguggaacucaucagaggccggcccaaagagaacacaauuuggacguccgggagcucuaucuccuuuuguggaguuaauagcgacaccgugggcuggucuuggcccgauggggcugagcugccuuucacaaucgacaaguga

SEQ ID NO: 202194 - RNA, 1410 nt, Artificial Sequence; identical to SEQ ID NO: 200116
  derived and/or modified sequence opt5 from neuraminidase__InfluenzaA__ADK90261

SEQ ID NO: 202195 - RNA, 1410 nt, Artificial Sequence
  derived and/or modified sequence opt5 from neuraminidase__InfluenzaA__ADK90265
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaugggauacaucuguucuggcauuuuuggggauaauccucgccccaacgacaaaaccggauccugcggcccggucagcucuaauggggccaacggagugaagggcuucuccuuuaaguauggcaacgggguuuggaucggaagaacaaaaagcauuuccucucggaauggcuucgagaugaucugggauccuaacggguggaccggaaccgacaauaacuuuagcauuaagcaagacaucgugggcaucaaugaaugguccggguacucuggcagcuucguccagcaucccgagcuuacaggacuggauuguauucgcccuugcuucuggguggaacucaucagaggccggcccaaagagaacacgauuuggaccuccgggagcucuaucuccuuuuguggaguuaauagcgacacagugggcuggucuuggcccgauggggcugagcugccuuucaccauugacaaguga

SEQ ID NO: 202196 - RNA, 1410 nt, Artificial Sequence
  derived and/or modified sequence opt5 from neuraminidase__InfluenzaA__ADK90269
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagaaauguaaccaauccgucauuacguacgaaaauaacaccuggguuaaucagacauaugugaacaucucuaauaccaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcacauuuuuccugacccagggcgcccuucugaaugacaaacauuccaacggcacaauuaaggauagaagcccuuaucggacccucaugucuugucccaucggggaggugccuucccccuacaacagccgcuuugaauccguugccuggucugcuagcgccugccacgacggaauuaauuggcugacgaucggcaucuccgggccugauaacggagcuguggccguccugaaguauaauggcauuaucaccgacacaauuaaaagcuggagaaacaauauccuccggacccaagagucugagugugcgugcgugaacggguccuguuucacagugaugaccgauggaccgagcgacggccaggccucuuacaagauuuuucgcaucgaaaaaggcaagaucgucaaaagcauugagaugaaugcucccaacuaucauuacgaagagugcuccuguuacccugauucuagcgagaucacgugcguuugcagagacaauuggcacggguccaaccggcccugggugagcuucaaucagaaccuggaauaucagauuggauacaucuguucuggcauuuuuggggauaauccucgccccaacgacaagacaggauccugcggcccggugagcucuaauggggccaacggagucaagggcuucuccuuuaaauauggcaacgggguguggaucggaagaaccaagagcauuuccucucggaauggcuucgagaugaucugggauccuaacggguggacaggaaccgacaauaacuuuagcaucaaacaagacauuguuggcaucaaugaaugguccggguacucuggcagcuucgugcagcaucccgagcuuaccggacuggauuguauucgcccuugcuucugggucgaacucaucagaggccggcccaaggagaacacaauuuggacguccgggagcaucaucucuuuuuguggaguuaauuccgacaccgugggcuggagcuggcccgauggggcugagcugccuuucacaauugacaaauga

SEQ ID NO: 202197 - RNA, 1410 nt, Artificial Sequence; identical to SEQ ID NO: 199762
  derived and/or modified sequence opt5 from neuraminidase__InfluenzaA__ADK90273

SEQ ID NO: 202198 - RNA, 1410 nt, Artificial Sequence; identical to SEQ ID NO: 199762
  derived and/or modified sequence opt5 from neuraminidase__InfluenzaA__ADK90277

SEQ ID NO: 202199 - RNA, 1410 nt, Artificial Sequence; identical to SEQ ID NO: 199762
  derived and/or modified sequence opt5 from neuraminidase__InfluenzaA__ADK90281

SEQ ID NO: 202200 - RNA, 1410 nt, Artificial Sequence
  derived and/or modified sequence opt5 from neuraminidase__InfluenzaA__ADK90289
augaaccccaaucagaagaucauuaccaucggcagcgugugcaugacaauugggauggccaaccugauccuccaaauuggaaauaucaucuccauuuggaucucucacagcauucagcugggcaaccagaaucuuaucgagacguguaaccaguccgucauuaccuacgaaaauaacacauggguuaaucaaaccuaugugaacaucucuaauacaaacuucgcugccgggcagagcguggucuccgugaaacuggcgggaaauucuagccucugcccuguuuccggcugggcuauuuacagcaaggacaacucuaucagaaucggguccaaaggagauguguuugucauucgggagccguucaucagcuguucuccccuggaaugccgcaccuuuuuccuuacacagggcgcccugcucaaugacaagcauuccaacggcaccauuaaagauagaagcccuuaucggacgcugaugucuugucccaucggggaggugccuucccccuacaacagccgcuuugaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaggagucugagugugcgugcgugaacggguccuguuucaccgugaugacggauggaccgagcgacggccaagccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuugaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguacucuggcagcuucguccaacaucccgagcugacaggacucgauuguauccgcccuugcuucuggguggaacugauuagaggccggcccaaagagaacacgaucuggaccuccgggagcucuauuuccuuuuguggaguuaauagcgacacagugggcuggucuuggcccgauggggcugagcuuccuuucaccaucgacaaguga

SEQ ID NO: 202201 - RNA, 1410 nt, Artificial Sequence; identical to SEQ ID NO: 201741
  derived and/or modified sequence opt5 from neuraminidase__InfluenzaA__ADK90293

SEQ ID NO: 202202 - RNA, 1410 nt, Artificial Sequence; identical to SEQ ID NO: 201653
  derived and/or modified sequence opt5 from neuraminidase__InfluenzaA__ADK90297

SEQ ID NO: 202203 - RNA, 1410 nt, Artificial Sequence; identical to SEQ ID NO: 199762
  derived and/or modified sequence opt5 from neuraminidase__InfluenzaA__ADK90301

SEQ ID NO: 202204 - RNA, 1410 nt, Artificial Sequence; identical to SEQ ID NO: 201653
  derived and/or modified sequence opt5 from neuraminidase__InfluenzaA__ADK90305

SEQ ID NO: 202205 - RNA, 1410 nt, Artificial Sequence; identical to SEQ ID NO: 199762
  derived and/or modified sequence opt5 from neuraminidase__InfluenzaA__ADK90309

SEQ ID NO: 202206 - RNA, 1410 nt, Artificial Sequence
  derived and/or modified sequence opt5 from neuraminidase__InfluenzaA__ADK90313
augaaccccaaucacaagaucauuaccaucggcagcgugugcaugacaauugggauggccaaccugauccuccagauuggaaauaucaucuccauuuggaucucucauagcauucaacugggcaaccagaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcacuccaacggcaccauuaaagauagaagcccucaucggacgcucaugucuugucccaucggggaggugccuucccccuauaacagccgcuuugaauccguugccuggucugcuagcgccugccacgacggaauuaauuggcugaccaucggcaucuccgggccugauaacggagcuguggccguccugaaguacaauggcauuaucacagacaccauuaagagcuggagaaacaauauccuccggacacaggagucugagugugcgugcgugaacggguccuguuucaccgugaugacggauggaccgagcgacggccaagccucuuauaaaauuuuucgcaucgaaaagggcaaaaucgucaagagcguugagaugaaugcucccaacuaccauuaugaagagugcuccuguuacccugauucuagcgagauuacaugcgugugcagagacaauuggcacggguccaaccggcccugggugagcuucaaucagaaccuggaauaccagaucggauauauuuguucuggcaucuuuggggauaauccucgccccaacgacaaaaccggauccugcggcccggucagcucuaauggggccaacggagugaagggcuucuccuuuaaguacggcaacgggguuuggauuggaagaacaaaaagcaucuccucucggaauggcuucgagaugauuugggauccuaacggguggaccggaaccgacaauaacuuuagcaucaagcaggacaucgugggcauuaaugaaugguccggguauucuggcagcuucguccaacaccccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccaucgacaaguga

SEQ ID NO: 202207 - RNA, 1410 nt, Artificial Sequence; identical to SEQ ID NO: 199762
  derived and/or modified sequence opt5 from neuraminidase__InfluenzaA__ADK90317

SEQ ID NO: 202208 - RNA, 1410 nt, Artificial Sequence; identical to SEQ ID NO: 201741
  derived and/or modified sequence opt5 from neuraminidase__InfluenzaA__ADK90321

SEQ ID NO: 202209 - RNA, 1410 nt, Artificial Sequence; identical to SEQ ID NO: 199762
  derived and/or modified sequence opt5 from neuraminidase__InfluenzaA__ADK90325

SEQ ID NO: 202210 - RNA, 1410 nt, Artificial Sequence
  derived and/or modified sequence opt5 from neuraminidase__InfluenzaA__ADK90329
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaacagauccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuauccggaucggguccaaaggagauguguuugucauucgcgagccguucaucagcuguucuccccucgaaugcagaaccuuuuuccugacacagggcgcccuucugaaugacaagcauuccaacggcaccauuaaagaucggagcccuuaucgcacgcucaugucuugucccaucggggaggugccuucccccuacaacagcagauuugaauccguugccuggucugcuagcgccugccacgacggaauuaauuggcugaccaucggcaucuccgggccugauaacgaggcuguggccguccugaaguauaauggaauuaucacagacaccauuaagagcuggcggaacaauauccuccgcacacaggagucugaaugugcgugcgugaacggcuccuguuucaccgugaugacggaugggccgagcgacggacaagccucuuacaaaauuuuuagaaucgagaagggcaaaaucgucaagagcguugaaaugaaugcucccaacuaucauuacgaggagugcuccuguuacccugauucuagcgaaauuacaugcgugugccgggacaauuggcacggcuccaaccgccccugggugagcuucaaucagaaccuggaguaucagaucggguacauuuguucuggaaucuuuggcgauaauccuagacccaacgacaaaaccggguccugcggaccggucagcucuaauggcgccaacggggugaagggauucuccuuuaaguauggcaacggcguuuggauugggcggacaaaaagcaucuccucucgcaauggauucgaaaugauuugggauccuaacggcuggaccgggaccgacaauaacuuuagcaucaagcaggacaucgugggaauuaaugagugguccggcuacucugggagcuucguccaacaucccgaacuuacaggccuggauuguaucagaccuugcuucuggguggagcucauucggggacgccccaaagagaacacgaucuggaccuccggcagcucuauuuccuuuugugggguuaauagcgacacagugggauggucuuggcccgauggcgcugaacugccuuucaccaucgacaaguga

SEQ ID NO: 202211 - RNA, 1410 nt, Artificial Sequence
  derived and/or modified sequence opt5 from neuraminidase__InfluenzaA__ADK90333
augaaccccaaucagaagaucauuaccaucggcagcgugugcaugacaauugggauggccaaccugauccuccaaauuggaaauaucaucuccauuuggaucucucacagcauucagcugggcaacaaaaaucagaucgagacguguaaccaguccgucauuaccuacgaaaauaacacauggguuaaucaaaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaagggagauguguuugucauucgggagccguucaucagcuguucuccccucgaaugccgcaccuuuuuccugacacagggcgcccuucugaaugacaaacauuccaacggcaccauuaaggauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaaaagcuggagaaacaauauccuccggacacaggagucugagugugcgugcgugaacggguccuguuucaccgugaugacggauggaccgagcgacggccaagccucuuacaagauuuuucgcaucgaaaaaggcaagaucgucaaaagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaagaccggauccugcggcccggucagcucuaauggggccaacggagugaagggcuucuccuuuaaauauggcaacgggguuuggauuggaagaacaaagagcaucuccucucggaauggcuucgagaugauuugggauccuaacggguggaccggaaccgacaauaacuuuagcaucaaacaggacaucgugggcauuaaugaaugguccggguacucuggcagcuucguccaacaucccgagcuuacaggacuggauuguauccgcccuugcuucuggguggaacucauuagaggccggcccaaggagaacacgaucuggaccuccgggagcucuauuuccuuuuguggaguuaauagcgacacagugggcuggucuuggcccgauggggcugagcugccuuucaccaucgacaaauga

SEQ ID NO: 202212 - RNA, 1410 nt, Artificial Sequence; identical to SEQ ID NO: 201741
  derived and/or modified sequence opt5 from neuraminidase__InfluenzaA__ADK90337

SEQ ID NO: 202213 - RNA, 1410 nt, Artificial Sequence; identical to SEQ ID NO: 200821
  derived and/or modified sequence opt5 from neuraminidase__InfluenzaA__ADK90341

SEQ ID NO: 202214 - RNA, 1410 nt, Artificial Sequence; identical to SEQ ID NO: 200821
  derived and/or modified sequence opt5 from neuraminidase__InfluenzaA__ADK90345

SEQ ID NO: 202215 - RNA, 1410 nt, Artificial Sequence; identical to SEQ ID NO: 200821
  derived and/or modified sequence opt5 from neuraminidase__InfluenzaA__ADK90349

SEQ ID NO: 202216 - RNA, 1410 nt, Artificial Sequence; identical to SEQ ID NO: 201741
  derived and/or modified sequence opt5 from neuraminidase__InfluenzaA__ADK90353

SEQ ID NO: 202217 - RNA, 1410 nt, Artificial Sequence; identical to SEQ ID NO: 199762
  derived and/or modified sequence opt5 from neuraminidase__InfluenzaA__ADK90357

SEQ ID NO: 202218 - RNA, 1410 nt, Artificial Sequence; identical to SEQ ID NO: 201741
  derived and/or modified sequence opt5 from neuraminidase__InfluenzaA__ADK90361

SEQ ID NO: 202219 - RNA, 1410 nt, Artificial Sequence; identical to SEQ ID NO: 200736
  derived and/or modified sequence opt5 from neuraminidase__InfluenzaA__ADK90365

SEQ ID NO: 202220 - RNA, 1410 nt, Artificial Sequence; identical to SEQ ID NO: 199762
  derived and/or modified sequence opt5 from neuraminidase__InfluenzaA__ADK90369

SEQ ID NO: 202221 - RNA, 1410 nt, Artificial Sequence; identical to SEQ ID NO: 199762
  derived and/or modified sequence opt5 from neuraminidase__InfluenzaA__ADK90373

SEQ ID NO: 202222 - RNA, 1410 nt, Artificial Sequence
  derived and/or modified sequence opt5 from neuraminidase__InfluenzaA__ADK90377
augaaccccaaucagaagaucauuaccaucggcagcgugugcaugacaauugggaugacgaaccugauccuccaaauuggaaauaucaucuccauuuggaucucucacagcauucagcugggcaaccagaaucagaucgagaccuguaaccaauccgucauuacauacgaaaauaacaccuggguuaaucagacauaugugaacaucucuaauaccaacuucgccgcugggcagagcguggucuccgugaaacuugccggaaauucuagccugugcccuguuuccggcugggcgauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacgauuaaagauagaagcccucaccggacccucaugucuugucccaucggggaggugccuucccccuauaacagccgcuuugaauccguugcuuggucugccagcgcuugccaugacggaauuaauuggcugacaaucggcaucuccgggccugauaacggagccguggcuguccugaaguacaauggcauuaucaccgacacaauuaagagcuggagaaacaauauccuccggacccaagagucugagugugccugcgugaacggguccuguuucacggugaugacagauggaccgagcgacggccaggcgucuuauaaaauuuuucgcaucgaaaagggcaaaaucgucaagagcguugagauggaugcccccaauuaccacuaugaagagugcuccuguuacccugacucuagcgagauuaucugcgugugcagagauaacuggcauggguccaaucggcccugggugagcuucaaccagaaucuggaauaccagauuggauauaucuguucuggcauuuuuggggacaacccucgccccaaugauaaaaccggauccugcggcccggucagcucuaacggggcuaauggagugaagggcuucuccuuuaaguacggcaacgggguuuggaucggaagaacaaaaagcauuuccucucggaacggcuucgagaugaucugggacccuaauggguggaccggaaccgacaacaauuuuagcaucaagcaagauauugugggcaucaacgaaugguccggguauucuggcagcuucguccagcaccccgagcuuacaggacuggacuguauucgcccuugcuucuggguggaacucaucagaggccggcccaaagagaauacgauuuggaccuccgggagcucuaucuccuuuuguggaguuaacagcgauacagugggcuggucuuggcccgacggggccgagcugccuuucaccaucgauaaguga

SEQ ID NO: 202223 - RNA, 1410 nt, Artificial Sequence; identical to SEQ ID NO: 201741
  derived and/or modified sequence opt5 from neuraminidase__InfluenzaA__ADK90381

SEQ ID NO: 202224 - RNA, 1410 nt, Artificial Sequence
  derived and/or modified sequence opt5 from neuraminidase__InfluenzaA__ADK90385
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuuucuggaaauagcucccugugcccuguuagcggcugggcgauuuacucuaaggacaacuccaucagaaucgggagcaaaggagauguguuugucauucgggagccguucaucucuuguagcccccucgaaugccgcaccuuuuuccugacacagggcgcccuucugaaugacaagcauuccaacggcaccauuaaagauagaucuccucaccggacgcucauguccugucccaucggggaggugccuagccccuauaacucccgcuuugaaucuguugcuuggagcgccuccgcuugccaugacggaauuaauuggcugaccaucggcaucagcgggccugauaacggagccguggcuguccugaaguacaauggcauuaucacagacaccauuaagucuuggagaaacaauauccuccggacacaagaguccgaguguaccugcgugaacgggagcuguuucacggugaugacagauggaccgucugacggccaggccagcuauaaaauuuuucgcaucgaaaagggcaaaaucgucaaguccguugagaugaaugcgcccaacuaccacuaugaagagugcucuuguuacccugauagcuccgagauuaccugcgugugcagagacaauuggcaugggagcaaccggcccugggugucuuucaaucagaaccuggaauaccagaucggauauauuuguuccggcaucuuuggggauaauccucgccccaacgacaaaacaggaagcugcggcccggucucuuccaauggggccaacggagugaagggcuucagcuuuaaguacggcaacgggguuuggauuggaagaaccaaauccaucucuagccggaauggcuucgagaugauuugggauccuaacggguggaccggaacagacaauaacuuuuccaucaagcaagacaucgugggcauuaaugaauggucuggguauagcggcuccuucguccagcaccccgagcuuacgggacuggauuguauccgcccuugcuucuggguggaacucauuagaggccggcccaaagagaacaccaucuggacaagcgggucuuccauuagcuuuuguggaguuaauucugacaccgugggcugguccuggcccgauggggcugagcugccuuucacaaucgacaaguga

SEQ ID NO: 202225 - RNA, 1410 nt, Artificial Sequence; identical to SEQ ID NO: 199762
  derived and/or modified sequence opt5 from neuraminidase__InfluenzaA__ADK90389

SEQ ID NO: 202226 - RNA, 1410 nt, Artificial Sequence; identical to SEQ ID NO: 201741
  derived and/or modified sequence opt5 from neuraminidase__InfluenzaA__ADK90393

SEQ ID NO: 202227 - RNA, 1410 nt, Artificial Sequence; identical to SEQ ID NO: 201653
  derived and/or modified sequence opt5 from neuraminidase__InfluenzaA__ADK90397

SEQ ID NO: 202228 - RNA, 1410 nt, Artificial Sequence; identical to SEQ ID NO: 199762
  derived and/or modified sequence opt5 from neuraminidase__InfluenzaA__ADK90401

SEQ ID NO: 202229 - RNA, 1410 nt, Artificial Sequence
  derived and/or modified sequence opt5 from neuraminidase__InfluenzaA__ADK90405
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccucaccggacgcucaugucuugucccaucggggaggugccuucccccuauaacagccgcuuugaauccguugccuggucugcuagcgccugccaugacggaauuaauuggcugaccaucggcaucuccgggccugauaacggagcuguggccguccugaaguacaauggcauuaucacagacaccauuaagagcuggagaaacaauauccuccggacacaagagucugaguguaccugcgugaacggguccuguuucacggugaugacagauggaccgagcgacggccaggcgucuuauaaaauuuuucgcaucgaaaagggcaaaaucgucaagagcguugagaugaaugcccccaacuaccacuaugaagagugcuccuguuacccugauucuagcgagauuaccugcgugugcagagacaauuggcauggguccaaccggcccugggugagcuucaaucagaaccuggaauaccagaucggauauauuuguucuggcaucuuuggggauaauccucgccccaacgacaaaacaggauccugcggcccggucagcucuaauggggcuaacggagugaagggcuucuccuuuaaguacggcaacgggguuuggauuggaagaaccaaaagcaucuccucucggaauggcuucgagaugauuugggauccuaacggguggaccggaacagacaauaacuuuagcaucaagcaagacaucgugggcauuaaugaaugguccggguauucuggcagcuucguccagcaccccgagcuuacgggacuggauuguauccgcccuugcuucuggguggaacucauuagaggccggcccaaagagaacaccaucuggacauccgggagcucuauuuccuuuuguggaguuaauagcgacaccgugggcuggucuuggcccgauggggccgagcugccuuucacaaucgacaaguga

SEQ ID NO: 202230 - RNA, 1410 nt, Artificial Sequence; identical to SEQ ID NO: 199762
  derived and/or modified sequence opt5 from neuraminidase__InfluenzaA__ADK90409

SEQ ID NO: 202231 - RNA, 1410 nt, Artificial Sequence
  derived and/or modified sequence opt5 from neuraminidase__InfluenzaA__ADK90413
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccucaccggacgcucaugucuugucccaucggggaggugccuucccccuauaacagccgcuuugaauccguugccuggucugcuagcgccugccaugacggaauuaauuggcugaccaucggcaucuccgggccugauaacggagcuauggccgugcugaaguacaauggcauuaucacagacaccauuaagagcuggagaaacaauauccuccggacacaagagucugagugugcgugcgucaacggguccuguuucaccgugaugacggauggaccgagcgacggccaggccucuuauaaaauuuuucgcaucgaaaagggcaaaaucgucaagagcguggagaugaaugcucccaacuaccacuaugaagagugcuccuguuacccugauucuagcgagauuacaugcguuugcagagacaauuggcauggguccaaccggcccugggugagcuucaaucagaaccuggaauaccagaucggauauauuuguucuggcaucuuuggggauaauccucgccccaacgacaaaaccggauccugcggcccggugagcucuaauggggccaacggagucaagggcuucuccuuuaaguacggcaacgggguguggauuggaagaacaaaaagcaucuccucucggaauggcuucgagaugauuugggauccuaacggguggaccggaaccgacaauaacuuuagcaucaagcaagacaucguuggcauuaaugaaugguccggguauucuggcagcuucgugcagcaccccgagcuuacaggacuggauuguauccgcccuugcuucugggucgaacucauuagaggccggcccaaagagaacacgaucuggaccuccgggagcucuauuuccuuuuguggagugaauagcgacacaguuggcuggucuuggcccgauggggcugagcugccuuucaccaucgacaaguga

SEQ ID NO: 202232 - RNA, 1410 nt, Artificial Sequence; identical to SEQ ID NO: 199762
  derived and/or modified sequence opt5 from neuraminidase__InfluenzaA__ADK90417

SEQ ID NO: 202233 - RNA, 1410 nt, Artificial Sequence; identical to SEQ ID NO: 199762
  derived and/or modified sequence opt5 from neuraminidase__InfluenzaA__ADK90421

SEQ ID NO: 202234 - RNA, 1410 nt, Artificial Sequence; identical to SEQ ID NO: 199762
  derived and/or modified sequence opt5 from neuraminidase__InfluenzaA__ADK90425

SEQ ID NO: 202235 - RNA, 1410 nt, Artificial Sequence; identical to SEQ ID NO: 199762
  derived and/or modified sequence opt5 from neuraminidase__InfluenzaA__ADK90429

SEQ ID NO: 202236 - RNA, 1410 nt, Artificial Sequence; identical to SEQ ID NO: 199623
  derived and/or modified sequence opt5 from neuraminidase__InfluenzaA__ADK94194

SEQ ID NO: 202237 - RNA, 1410 nt, Artificial Sequence; identical to SEQ ID NO: 199623
  derived and/or modified sequence opt5 from neuraminidase__InfluenzaA__ADK94205

SEQ ID NO: 202238 - RNA, 1410 nt, Artificial Sequence; identical to SEQ ID NO: 200929
  derived and/or modified sequence opt5 from neuraminidase__InfluenzaA__ADK94216

SEQ ID NO: 202239 - RNA, 1410 nt, Artificial Sequence; identical to SEQ ID NO: 199623
  derived and/or modified sequence opt5 from neuraminidase__InfluenzaA__ADK94227

SEQ ID NO: 202240 - RNA, 1410 nt, Artificial Sequence; identical to SEQ ID NO: 199623
  derived and/or modified sequence opt5 from neuraminidase__InfluenzaA__ADK94238

SEQ ID NO: 202241 - RNA, 1410 nt, Artificial Sequence; identical to SEQ ID NO: 202147
  derived and/or modified sequence opt5 from neuraminidase__InfluenzaA__ADK94260

SEQ ID NO: 202242 - RNA, 1410 nt, Artificial Sequence; identical to SEQ ID NO: 202147
  derived and/or modified sequence opt5 from neuraminidase__InfluenzaA__ADK94271

SEQ ID NO: 202243 - RNA, 1410 nt, Artificial Sequence; identical to SEQ ID NO: 199623
  derived and/or modified sequence opt5 from neuraminidase__InfluenzaA__ADK94293

SEQ ID NO: 202244 - RNA, 1410 nt, Artificial Sequence; identical to SEQ ID NO: 199623
  derived and/or modified sequence opt5 from neuraminidase__InfluenzaA__ADK94304

SEQ ID NO: 202245 - RNA, 1410 nt, Artificial Sequence
  derived and/or modified sequence opt5 from neuraminidase__InfluenzaA__ADK94326
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacauucauagcaauaacaccgugcgggaucgcacgccguauagaacacuccugaugaaugaacugggcguucccuuucaccucgggaccaaacaggugugcaucgccugguccucuagcuccugucaugacggaaaggccuggcugcacgucugcauuacaggcgaugacaagaacgcuaccgccagcuucaucuacaauggccggcuuguggauucuguuguguccuggagcaaagagauucugcgcacccaggaaucugagugugucugcaucaacgggacauguacgguggugaugaccgacggauccgcuagcggcaaggccgauacaaaaauccucuuuauugaggaagggaagaucguccauaccuccacacugucuggaagcgcgcaacacguugaggaaugcuccugcuauccuagauaccccggcgugcggugugugugccgcgacaacuggaaggggagcaauagaccuauugucgauaucaacauuaaagaccacucuaucguguccagcuacguuuguucuggacuugugggcgacacgccccggaagaaugauagcuccucuagcucccauugccuggacccgaacaaugaggaaggcgggcacggagucaaaggcugggccuucgaugacgggaacgauguguggaugggacgcaccaucagcgagaagucuagacucggcuaugagacauuuaaaguuauugaagggugguccaauccuaagagcaaacugcagaucaaccgccaggugauugucgaccggggaaauagaucuggcuacuccggcaucuucagcguggaggggaaguccuguauuaaccggugcuuuuaugucgaacugaucagaggacgcaaggaggaaaccgaggugcucuggaccucuaauagcauuguuguguucuguggcacauccgggaccuacggaacaggcucuuggcccgauggggcugacaucaaccugaugccuaucuga

SEQ ID NO: 202246 - RNA, 1410 nt, Artificial Sequence; identical to SEQ ID NO: 200929
  derived and/or modified sequence opt5 from neuraminidase__InfluenzaA__ADK94337

SEQ ID NO: 202247 - RNA, 1410 nt, Artificial Sequence; identical to SEQ ID NO: 199623
  derived and/or modified sequence opt5 from neuraminidase__InfluenzaA__ADK94444

SEQ ID NO: 202248 - RNA, 1410 nt, Artificial Sequence
  derived and/or modified sequence opt5 from neuraminidase__InfluenzaA__ADK94479
augaaccccaaucagaagaucauuaccaucggcagcgugucccugacaauuucuacgaucugcuuccucaugcaaauugccauccugaccacaaccgucacacuucacuuuaaacaguacgaguucaacagcccuccgaauaaccagguuaugcugugugaacccaccacaaucgagagaaauauuaccgaaaucguguaucucacgaacaccacaauugagaaggaaaucugcccuaaacuggcugaguaccggaauugguccaagccccagugugacauuaccggguuugccccuuucucuaaagauaacagcauccgccuuuccgcgggaggcgacauuugggugacaagagagcccuaugucucuugcgauccugacaaguguuaccaauuugcucuggggcagggaaccacgcucaauaacgugcauagcaauaacacaguucgggaucgcaccccguauagaacacugcugaugaaugaacucggcgugcccuuccaccuggggaccaagcaggucugcaucgccugguccucuagcuccugucaugacggaaaagccuggcuucacgugugcaucaccggcgaugacaagaacgcuacagccagcuuuauuuacaauggcaaacugguugauucuguggucuccuggagcaaggagauccuccggacgcaggaaucugagugugugugcauuaacgggaccuguacaguggucaugaccgacggauccgcuagcggcaaagccgauacaaagauccuguucauugaggaagggaagaucguucauaccuccacgcuuucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuaccuguguucuggacucgugggcgacacaccccggaaaaaugauagcuccucuagcucccauugccuggacccgaacaaugaggaaggcgggcacggagucaagggcugggccuuugaugacgggaacgauguguggaugggaagaaccaucagcgagaaaucucgccugggcuaugagaccuucaagguuauugaagggugguccaauccuaaaagcaagcuccagaucaacagacaggugaucgucgaccggggaaaucgcucuggcuacuccggcauuuuuagcguggaggggaaguccuguaucaacagaugcuucuaugucgaacugauucggggaagaaaagaggaaacaggcgugcuuuggaccucuaauagcaucguuguguuuugugggacauccggaacguacggcaccgggucuuggcccgauggcgcugacauuaaccugaugccuaucuga

SEQ ID NO: 202249 - RNA, 1410 nt, Artificial Sequence; identical to SEQ ID NO: 199623
  derived and/or modified sequence opt5 from neuraminidase__InfluenzaA__ADK94490

SEQ ID NO: 202250 - RNA, 1410 nt, Artificial Sequence; identical to SEQ ID NO: 199623
  derived and/or modified sequence opt5 from neuraminidase__InfluenzaA__ADK94501

SEQ ID NO: 202251 - RNA, 1410 nt, Artificial Sequence
  derived and/or modified sequence opt5 from neuraminidase__InfluenzaA__ADK94512
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggagaauuguucauaccuccacacugucuggaagcgcgcaacacguggaggaaugcuccugcuauccucgguaccccggcgugcgcugugucugcagagacaacuggaaggggagcaaucggccuaucguggauauuaacaucaaggaccacucuauuguuuccagcuacguguguucuggacuugucggcgacacgccccgcaaaaaugauagcuccucuagcucccauugccuggacccgaacaaugaggaaggcgggcacggagugaagggcugggccuucgaugacgggaacgauguuuggaugggaagaaccaucagcgagaaaucucggcucggcuaugagacauuuaaggugaucgaagggugguccaauccuaaaagcaagcugcagauuaaccgccaggucaucguggacagaggaaaucggucuggcuacuccggcauuuucagcgucgaggggaaauccuguaucaacagaugcuuuuauguggaacugauucgcggacggaaggaggaaaccgagguucucuggaccucuaauagcaucguggucuucuguggcacauccgggaccuacggaacaggcucuuggcccgauggggcugacauuaaccugaugccuaucuga

SEQ ID NO: 202252 - RNA, 1410 nt, Artificial Sequence; identical to SEQ ID NO: 199623
  derived and/or modified sequence opt5 from neuraminidase__InfluenzaA__ADK94534

SEQ ID NO: 202253 - RNA, 1410 nt, Artificial Sequence; identical to SEQ ID NO: 202147
  derived and/or modified sequence opt5 from neuraminidase__InfluenzaA__ADK94556

SEQ ID NO: 202254 - RNA, 1410 nt, Artificial Sequence; identical to SEQ ID NO: 199623
  derived and/or modified sequence opt5 from neuraminidase__InfluenzaA__ADK94567

SEQ ID NO: 202255 - RNA, 1410 nt, Artificial Sequence; identical to SEQ ID NO: 199623
  derived and/or modified sequence opt5 from neuraminidase__InfluenzaA__ADK94578

SEQ ID NO: 202256 - RNA, 1410 nt, Artificial Sequence; identical to SEQ ID NO: 199623
  derived and/or modified sequence opt5 from neuraminidase__InfluenzaA__ADK94589

SEQ ID NO: 202257 - RNA, 1410 nt, Artificial Sequence; identical to SEQ ID NO: 201313
  derived and/or modified sequence opt5 from neuraminidase__InfluenzaA__ADK98504

SEQ ID NO: 202258 - RNA, 1410 nt, Artificial Sequence
  derived and/or modified sequence opt5 from neuraminidase__InfluenzaA__ADK98506
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaaaaugucauuaccuacgaaaacaauacauggguuaaccagaccuaugugaauaucuccaacacaaauuucgcugccgggcagucuguggucagcgugaaacuugcgggaaacuccucucugugcccuguuagcggcugggcuauuuacuccaaggacaauagcaucagaaucgggucuaaaggagauguguuugucauucgggagccguucaucuccuguagcccccucgaaugccgcaccuuuuuccugacacagggcgcccuucugaacgacaagcauucuaacggcaccauuaaagauagauccccuuaucggacgcucaugagcugucccaucggggaggugccuucucccuacaauucccgcuuugaaagcguugccugguccgcuucugccugccacgacggaauuaacuggcugaccaucggcaucagcgggccugauaauggagcuguggccguccugaaguauaacggcauuaucacagacaccauuaaguccuggagaaauaacauccuccggacacaagagagcgagugugcgugcgugaaugggucuuguuucaccgugaugacggauggaccguccgacggccaggccagcuacaaaauuuuucgcaucgaaaagggcaaaaucgucaagucuguugagaugaacgcucccaauuaucauuacgaagagugcagcuguuacccugauuccucugagauuacaugcgugugcagagacaacuggcacgggagcaaucggcccuggguguccuucaaccagaaucuggaauaucagaucggauacauuuguagcggcaucuuuggggauaacccucgccccaaugacaaaaccggaucuugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 202259 - RNA, 1410 nt, Artificial Sequence
  derived and/or modified sequence opt5 from neuraminidase__InfluenzaA__ADK98626
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaaugauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcaucgccugguccucuagcuccugucaugacggaaaagccuggcugcacgugugcauuacaggcgaugacaagaacgcuaccgccagcuucaucuacaauggccggcuuguugauucuguggucuccuggagcaaagagauucugcgcacccaggaaucugagugugugugcaucaacgggacauguacgguggucaugaccgacggauccgcuagcggcaaggccgauacaaaaauucucuuuaucgaggaagggaagaucguucauaccuccacacugucuggaagcgcgcaacacguggaggaaugcuccugcuauccuagauaccccggcgugcggugugucugccgcgacaacuggaaggggagcaauagaccuauuguggauaucaacauuaaagaccacucuaucguuuccagcuaccuuuguucuggacuggugggcgacacgccccggaagaaugauagcuccucuagcucccauugccucgacccgaacaaugaggaaggcgggcacggagucaaaggcugggccuucgaugacgggaacgauguguggaugggacgcaccauuagcgagaagucuagacugggcuaugagacauuuaaaguuaucgaagggugguccaauccuaagagcaaacugcagaucaaccgccaggugauugucgaccggggaaauagaucuggcuacuccggcaucuucagcguggaggggaaguccuguauuaaccggugcuuuuaugucgaacucaucagaggacgcaaggaggaaaccgaggugcuguggaccucuaauagcauuguuguguucuguggcacauccgggaccuacggaacaggcucuuggcccgauggggcugacaucaaccuuaugccuauuuga

SEQ ID NO: 202260 - RNA, 1410 nt, Artificial Sequence; identical to SEQ ID NO: 200929
  derived and/or modified sequence opt5 from neuraminidase__InfluenzaA__ADK98637

SEQ ID NO: 202261 - RNA, 1410 nt, Artificial Sequence
  derived and/or modified sequence opt5 from neuraminidase__InfluenzaA__ADK98648
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcgcggaguuaaaggcugggccuucgacgaugggaacgacguguggaugggaagaaccauuagcgaaaagucucggcucggcuaugagacauuuaaagucaucgaggggugguccaauccuaagagcaaacugcagaucaaccgccaggugauugucgauagaggaaaucggucuggcuacuccggcaucuucagcguggaagggaaguccuguauuaacagaugcuuuuauguugagcugauccgcggacggaaggaagagaccgaagugcucuggaccucuaauagcauugucguguucuguggcacauccgggaccuacggaacaggcucuuggcccgacggggcuaacaucaaucugaugccuauuuga

SEQ ID NO: 202262 - RNA, 1410 nt, Artificial Sequence
  derived and/or modified sequence opt5 from neuraminidase__InfluenzaA__ADK98659
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcggccauugccuggacccgaacaaugaggaagggggacacggcgugaaagggugggccuucgaugacggaaacgauguuuggaugggccgcaccaucuccgagaagucuagacucggguaugagacauuuaaagugaucgaaggauggucuaaucauaaguccaaacugcagauuaaccggcaggucaucguggaccgcggcaauagaagcggcuacucugggauuuucuccgucgagggaaagagcuguaucaaccggugcuuuuauguggaacugauuagaggccgcaaggaggaaaccgagguucucuggaccuccaauucuaucguggucuucugugggacaagcggaaccuacggcacaggguccuggccugauggcgcugaccugaaccuuaugcccauuuga

SEQ ID NO: 202263 - RNA, 1410 nt, Artificial Sequence; identical to SEQ ID NO: 202147
  derived and/or modified sequence opt5 from neuraminidase__InfluenzaA__ADK98670

SEQ ID NO: 202264 - RNA, 1410 nt, Artificial Sequence
  derived and/or modified sequence opt5 from neuraminidase__InfluenzaA__ADK98681
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcgaggccgauacaaagauccucuuuaucgaagaggggaaaauuguucauaccuccacacugucuggaagcgcgcaacacguggaagagugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgagaaaucuagacucggcuaugaaacauuuaaggugaucgaggggugguccaauccuaaaagcaagcugcagaccaaccggcaggucauuguggaccgcggaaauagaucuggcuacuccggcaucuucagcgucgaagggaaaaacuguauuaaucggugcuuuuauguggagcugaucagaggacgcaaggaagagaccgagguucucuggacauccaacucuauuguggucuucuguggcaccagcgggacauacggaacgggcuccuggcccgauggggcugacaucaaucugaugccuauuuga

SEQ ID NO: 202265 - RNA, 1410 nt, Artificial Sequence
  derived and/or modified sequence opt5 from neuraminidase__InfluenzaA__ADK98703
augaaccccaaucagaagaucauuaccaucggcagcgugucccugacaauuucuacgaucugcuucuuuaugcaaaccgccauucucaucacaaccgucacacugcacuucaaacaguacgaguuuaacagcccuccgaauaaccagguuaugcuuugugaacccaccaucauugagagaaauaucacagaaauuguguaucugaccaacacgaccaucgagaaggaaauuugcccuaaacucgcugaguaccggaauugguccaagccccagugugacaucacaggguucgccccuuuuucuaaagauaacagcauucgccuguccgcgggaggcgacaucugggugaccagagagcccuaugucucuugcgauccugacaaguguuaccaauucgcucuugggcagggaacaacccugaauaacgugcauagcaauaacacgguucgggaucgcacaccguauagaacccuccugaugaaugaacugggcgugcccuuucaccucgggacaaagcaggucugcaucgccugguccucuagcuccugucaugacggaaaagccuggcugcacgugugcauuaccggcgaugacaagaacgcuaccgccagcuucaucuacaauggccggcuuguugauucuguggucuccuggagcaaagagauucugcgcacacaggaaucugagugugugugcaucaacgggacguguaccguggucaugacagacggauccgcuagcggcgaggccgauaccaagauucucuuuaucgaagaggggaaaaucguucauacauccacccugucuggaagcgcgcaacacguggaagagugcuccugcuauccuagauaccccggcgugcggugugucugccgcgacaacuggaaggggagcaauagaccuauuguggauaucaacauuaaggaccacucuaucguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcacaauuagcgagaaaucuagacucggcuaugaaaccuuuaaggugaucgaggggugguccaauccuaaaagcaagcugcagaccaaccggcaggucaucguggaccgcggaaauagaucuggcuacuccggcauuuucagcgucgaagggaaaaacuguaucaaucggugcuuuuauguggagcugauuagaggacgcaaggaagagacagagguucucuggaccuccaacucuaucguggucuucuguggcacaagcgggacguacggaaccggcuccuggcccgauggggcugacauuaaucugaugccuaucuga

SEQ ID NO: 202266 - RNA, 1410 nt, Artificial Sequence; identical to SEQ ID NO: 201508
  derived and/or modified sequence opt5 from neuraminidase__InfluenzaA__ADK98725

SEQ ID NO: 202267 - RNA, 1410 nt, Artificial Sequence; identical to SEQ ID NO: 202147
  derived and/or modified sequence opt5 from neuraminidase__InfluenzaA__ADK98736

SEQ ID NO: 202268 - RNA, 1410 nt, Artificial Sequence
  derived and/or modified sequence opt5 from neuraminidase__InfluenzaA__ADK98747
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacaugaaagaccacucuauuguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccaucagcgaaaagucuagacucggcuaugagacauuuaaagucauugaggggugguccaauccuaagagcaaacugcagaucaaccgccaggugaucgucgaucggggaaauagaucuggcuacuccggcauuuucagcguggaagggaaguccuguaucaaccggugcuuuuauguugagcugauuagaggacgcaaggaagagaccgaagugcucuggaccucuaauagcaucgucguguucuguggcacauccgggaccuacggaacaggcucuuggcccgacggggcuaacauuaaucugaugccuaucuga

SEQ ID NO: 202269 - RNA, 1410 nt, Artificial Sequence
  derived and/or modified sequence opt5 from neuraminidase__InfluenzaA__ADK98758
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccaacacaaaaauucucuuuaucgaggaggggaagaucgugcauaccuccacacugucuggaagcgcgcaacacguggaagagugcuccugcuauccuagauaccccggcguccggugugugugccgcgacaauuggaaggggagcaacagaccuauuguugauaucaauauuaaagaccacucuaucguguccagcuacgucuguucuggacuugugggcgacacgccccggaagaacgauagcuccucuagcucccauugccuggacccgaauaacgaagagggcgggcacggaguuaaaggcugggccuucgaugacgggaaugauguguggaugggacgcaccauuagcgaaaagucuagacucggcuaugagacauuuaaagucaucgaggggugguccaacccuaagagcaaacugcagaucaaucgccaggugauugucgaccggggaaacagaucuggcuacuccggcaucuucagcguggaagggaaguccuguauuaaucggugcuuuuauguugagcugaucagaggacgcaaggaagagaccgaagugcucuggaccucuaacagcauugucguguucuguggcacauccgggaccuacggaacaggcucuuggcccgauggggcuaauaucaaccugaugccuauuuga

SEQ ID NO: 202270 - RNA, 1410 nt, Artificial Sequence; identical to SEQ ID NO: 201508
  derived and/or modified sequence opt5 from neuraminidase__InfluenzaA__ADK98769

SEQ ID NO: 202271 - RNA, 1410 nt, Artificial Sequence; identical to SEQ ID NO: 202062
  derived and/or modified sequence opt5 from neuraminidase__InfluenzaA__ADK98780

SEQ ID NO: 202272 - RNA, 1410 nt, Artificial Sequence; identical to SEQ ID NO: 201508
  derived and/or modified sequence opt5 from neuraminidase__InfluenzaA__ADK98791

SEQ ID NO: 202273 - RNA, 1410 nt, Artificial Sequence; identical to SEQ ID NO: 199623
  derived and/or modified sequence opt5 from neuraminidase__InfluenzaA__ADK98802

SEQ ID NO: 202274 - RNA, 1410 nt, Artificial Sequence
  derived and/or modified sequence opt5 from neuraminidase__InfluenzaA__ADK98813
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccgcuauuaucgagagaaauauuacagaaaucguguaucugaccaacacaaccauugagaaggaaaucugcccuaaacucgccgaguaccggaauugguccaagccccagugugacauuacgggguucgcgccuuuuucuaaagauaacagcauccgccuguccgcuggaggcgacaucugggugaccagagagcccuaugucucuugcgauccugacaaguguuaccaauucgcccuugggcagggaacaacccugaauaacgugcauagcaauaacacaguucgggaucgcaccccguauagaacgcuccugaugaaugaacugggcgugcccuuucaccucgggacaaagcaggucugcauugccugguccucuagcuccugucaugacggaaaggcuuggcugcacgugugcaucaccggcgaugacaaaaacgccacagcuagcuucauuuacaauggccggcuuguugauucuguggucuccuggagcaaagagauccugcgcacccaggaaucugagugugugugcauuaacgggaccuguacaguggucaugacggacggauccgccagcggcaaggcggauaccaaaauccucuuuaucgaggaagggaagauuguucauacauccacccugucuggaagcgcccaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacaccccggaagaaugauagcuccucuagcucccauugccuggacccgaacaaugaggaaggcgggcacggagugaaaggcugggcuuucgaugacgggaacgauguuuggaugggacgcaccaucagcgagaagucuagacucggcuaugagacguuuaaagugaucgaagggugguccaaucauaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaacagagguucucuggaccucuaauagcaucguggucuucuguggcaccuccgggacauacggaaccggcucuuggccugauggggccgaccugaaccuuaugcccauuuga

SEQ ID NO: 202275 - RNA, 1410 nt, Artificial Sequence; identical to SEQ ID NO: 199623
  derived and/or modified sequence opt5 from neuraminidase__InfluenzaA__ADK98824

SEQ ID NO: 202276 - RNA, 1410 nt, Artificial Sequence; identical to SEQ ID NO: 201508
  derived and/or modified sequence opt5 from neuraminidase__InfluenzaA__ADK98835

SEQ ID NO: 202277 - RNA, 1410 nt, Artificial Sequence; identical to SEQ ID NO: 202147
  derived and/or modified sequence opt5 from neuraminidase__InfluenzaA__ADK98846

SEQ ID NO: 202278 - RNA, 1410 nt, Artificial Sequence
  derived and/or modified sequence opt5 from neuraminidase__InfluenzaA__ADK98857
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuagcgaaaagucuagacucggcuaugagacauuuaaagucaucgaggggugguccaaucauaagagcaaacugcagaucaaccgccaggugauugucgaucggggaaauagaucuggcuacuccggcaucuucagcguggaagggaaguccuguauuaaccggugcuuuuauguugagcugaucagaggacgcaaggaagagaccgaagugcucuggaccucuaauagcauugucguguucuguggcacauccgggaccuacggaacaggcucuuggccugacggggcuaacaucaaucugaugcccauuuga

SEQ ID NO: 202279 - RNA, 1410 nt, Artificial Sequence
  derived and/or modified sequence opt5 from neuraminidase__InfluenzaA__ADK98868
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaaugagguucucuggaccucuaacagcaucguggucuucuguggcaccuccgggacauacggaaccggcucuuggcccgauggggcugacauuaaucugaugccuaucuga

SEQ ID NO: 202280 - RNA, 1410 nt, Artificial Sequence
  derived and/or modified sequence opt5 from neuraminidase__InfluenzaA__ADK98879
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccaggcuaugcuuugugaacccacaauuaucgagagaaauauuaccgaaaucguuuaucugacaaacaccacgauugagaaggaaaucugcccuaaacucgccgaguaccggaauugguccaagccccagugugacauuaccggguucgcgccuuuuucuaaagauaacagcauccgccuguccgcuggaggcgacaucugggugacaagagagcccuaugugucuugcgauccugacaaguguuaccaauucgcccuugggcagggaaccacacugaauaacguccauagcaauaacaccgugcgggaucgcacgccguauagaacacuccugaugaaugaacugggcguucccuuucaccucgggaccaaacaggugugcauugccugguccucuagcuccugucaugacggaaaggcuuggcugcacgucugcaucacaggcgaugacaagaacgccaccgcuagcuucauuuacaauggccggcuuguggauucuguuguguccuggagcaaagagauccugcgcacccaggaaucugagugugucugcauuaacgggacauguacgguggugaugaccgacggauccgccagcggcaaggcggauacaaaaauccucuuuaucgaggaagggaagauuguccauaccuccacacugucuggaagcgcccaacacguugaggaaugcuccugcuauccuagauaccccggcgugcggugugugugccgcgacaacuggaaggggagcaauagaccuaucgucgauauuaacaucaaagaccacucuauuguguccagcuacguuuguucuggacuugugggcgacacgccccggaagaaugauagcuccucuagcucccauugccuggacccgaacaaugaggaaggcgggcacggagucaaaggcugggcuuucgaugacgggaacgauguguggaugggacgcaccaucagcgagaagucuagacucggcuaugagacauuuaaaguuaucgaagggugguccaauccuaagagcaaacugcagauuaaccgccaggugaucgucgaccggggaaauagaucuggcuacuccggcauuuucagcguggaggggaaguccuguaucaaccggugcuuuuaugucgaacugauuagaggacgcaaggaggaaaccgaggugcucuggaccucuaauagcaucguuguguucuguggcacauccgggaccuacggaacaggcucuuggcccgauggggccgacauuaaccugaugccuaucuga

SEQ ID NO: 202281 - RNA, 1410 nt, Artificial Sequence; identical to SEQ ID NO: 202147
  derived and/or modified sequence opt5 from neuraminidase__InfluenzaA__ADK98890

SEQ ID NO: 202282 - RNA, 1410 nt, Artificial Sequence; identical to SEQ ID NO: 201508
  derived and/or modified sequence opt5 from neuraminidase__InfluenzaA__ADK98901

SEQ ID NO: 202283 - RNA, 1410 nt, Artificial Sequence; identical to SEQ ID NO: 202062
  derived and/or modified sequence opt5 from neuraminidase__InfluenzaA__ADK98912

SEQ ID NO: 202284 - RNA, 1410 nt, Artificial Sequence; identical to SEQ ID NO: 202147
  derived and/or modified sequence opt5 from neuraminidase__InfluenzaA__ADK98923

SEQ ID NO: 202285 - RNA, 1410 nt, Artificial Sequence; identical to SEQ ID NO: 200929
  derived and/or modified sequence opt5 from neuraminidase__InfluenzaA__ADK98945

SEQ ID NO: 202286 - RNA, 1410 nt, Artificial Sequence
  derived and/or modified sequence opt5 from neuraminidase__InfluenzaA__ADK98956
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccagcagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuguuguguccagcuacgucuguucuggacuugugggcgacacgccccggaagucugauuccucuagcuccagccauugccuggacccgaauaacgaggaaggcgggcacggaguuaaaggcugggccuucgaugacgggaaugauguguggaugggacgcaccauuucugagaaguccagacucggcuaugagacauuuaaagucaucgaaggguggagcaaccauaagucuaaacugcagaucaaucgccaggugauugucgaccggggaaacagauccggcuacagcggcaucuucuccguggaggggaagucuuguauuaaucggugcuuuuauguugaacugaucagaggacgcaaggaggaaaccgaggugcucuggaccagcaacuccauugucguguucuguggcacaucugggaccuacggaacaggcagcuggccugauggggcugaccugaaucuuaugcccaucuga

SEQ ID NO: 202287 - RNA, 1410 nt, Artificial Sequence; identical to SEQ ID NO: 201508
  derived and/or modified sequence opt5 from neuraminidase__InfluenzaA__ADK98967

SEQ ID NO: 202288 - RNA, 1410 nt, Artificial Sequence; identical to SEQ ID NO: 202147
  derived and/or modified sequence opt5 from neuraminidase__InfluenzaA__ADK98978

SEQ ID NO: 202289 - RNA, 1410 nt, Artificial Sequence; identical to SEQ ID NO: 202286
  derived and/or modified sequence opt5 from neuraminidase__InfluenzaA__ADK98989

SEQ ID NO: 202290 - RNA, 1410 nt, Artificial Sequence; identical to SEQ ID NO: 199623
  derived and/or modified sequence opt5 from neuraminidase__InfluenzaA__ADK99000

SEQ ID NO: 202291 - RNA, 1410 nt, Artificial Sequence; identical to SEQ ID NO: 202286
  derived and/or modified sequence opt5 from neuraminidase__InfluenzaA__ADK99011

SEQ ID NO: 202292 - RNA, 1410 nt, Artificial Sequence
  derived and/or modified sequence opt5 from neuraminidase__InfluenzaA__ADK99022
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaccccacaaucauugaaagaaauaucaccgagauuguguaucugacaaacaccacgaucgaaaaggagauuugcccuaaacucgcugaauaccggaauugguccaagccccagugugauaucaccggguucgccccuuuuucuaaagacaacagcauucgccuguccgcgggaggcgauaucugggucacaagagagcccuaugugucuugcgacccugauaaguguuaccaauucgcucuugggcagggaaccacacugaauaacguucauagcaauaacaccgugcgggaccgcacgccguauagaacacuccugaugaaugagcugggcguccccuuucaccucgggaccaaacaggugugcaucgccugguccucuagcuccugucaugauggaaaggccuggcugcacguuugcauuacaggcgacgauaagaacgcuaccgccagcuucaucuacaauggccggcuuguggacucugucguguccuggagcaaagauauucugcgcacccaggaaucugagugugugugcaucaacgggacauguacggucguuaugaccgacggauccgcuagcggcaaggccgauacaaaaauucucuuuaucgaagaggggaagaucgugcauaccuccacacugucuggaagcgcgcaacacguggaggaaugcuccugcuauccuagauaccccggcguccggugugugugccgcgacaacuggaaggggagcaauagaccuauuguugacaucaacauuaaagaucacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugaaacauuuaaagucaucgaggggugguccaauccuaagagcaaacugcagaucaaccgccaggugauugucgaccggggaaauagaucuggcuacuccggcaucuucagcguggaggggaaguccuguauuaaccggugcuuuuauguugaacugaucagaggacgcaaggaggaaaccgaggugcucuggaccucuaauagcauugucguguucuguggcacauccgggaccuacggaacaggcucuuggcccgauggggcuaacaucaaucugaugccuauuuga

SEQ ID NO: 202293 - RNA, 1410 nt, Artificial Sequence; identical to SEQ ID NO: 199623
  derived and/or modified sequence opt5 from neuraminidase__InfluenzaA__ADK99033

SEQ ID NO: 202294 - RNA, 1410 nt, Artificial Sequence
  derived and/or modified sequence opt5 from neuraminidase__InfluenzaA__ADK99044
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauaagaccgaaauuguguaucugacaaacaccacgaucgagaaagaaauuugcccuaagcucgcugaguaccggaauugguccaaaccccagugugacaucaccggguucgccccuuuuucuaaggauaacagcauucgccuguccgcgggaggcgacaucugggugacaagagagcccuaugucucuugcgauccugacaaguguuaccaauucgcucuugggcagggaaccacacugaauaacggccauagcaauaacaccgugcgggaucgcacgccguauagaacacuccugaugaaugaacuggggguucccuuucaccucggaaccaaacaggugugcaucgccugguccucuagcuccugucaugacggcaaggccuggcugcacgucugcauuacaggcgaugacaaaaacgcuaccgccagcuucaucuacaaugggaaacuuguggauucuguuguguccuggagcaaggagauucugcggacccaggaaucugagugugucugcaucaacggaacauguacgguggugaugaccgacggcuccgcuagcgggaaggccgauacaaagauucucuuuaucgaggaaggaaaaaucguccauaccuccacacugucuggcagcgcgcaacacguugaggaaugcuccugcuauccucgcuaccccggggugagaugugugugccgggacaacuggaagggaagcaaucgcccuauugucgauaucaacauuaaagaccacucuaucguguccagcuacguuuguucuggccuugugggcgacacccccagaaagaaugauagcuccucuagcucccauugccuggacccgaacaaugaggaagggggacacggcgucaaagggugggccuucgaugacggaaacgauguguggaugggccggacgauuagcgagaagucucgccucggguaugagacauuuaaaguuaucgaaggaugguccaaucauaagagcaagcugcagaucaacagacaggugauugucgaccggggcaaucgcucuggcuacuccgggaucuucagcguggagggaaaauccuguauuaacagaugcuuuuaugucgaacugauccggggcagaaaggaggaaaccgaggugcucuggaccucuaauagcauuguuguguucugugggacauccggaaccuacggcacagggucuuggccugauggcgcugaccugaaccuuaugcccaucuga

SEQ ID NO: 202295 - RNA, 1410 nt, Artificial Sequence
  derived and/or modified sequence opt5 from neuraminidase__InfluenzaA__ADK99055
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaugaaagaccacucuaucguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccauuagcgagaagucuagacucggcuaugagacauuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacugaucagaggacgcaaggaggaaaccgagguucucuggaccucuaauagcauuguggucuucuguggcacauccgggaccuacggaacaggcucuuggcccgauggggcugacaucaaccugaugccuauuuga

SEQ ID NO: 202296 - RNA, 1410 nt, Artificial Sequence
  derived and/or modified sequence opt5 from neuraminidase__InfluenzaA__ADK99066
augaaccccaaucagaagaucauuaccaucggcagcgugucccugacaauuucuacgaucugcuucuuuaugcaaauugccauccucaucaccacagucacccugcacuucaaacagugugaguuuaacagcccuccgaauaaccagguuaugcuuugcgaacccacaauuaucgagagaaauauuaccgaaaucguguaccugacaaacaccacgauugagaagaaaaucuguccuaagcucgcugaauaucggaauugguccaaaccccagugcgacauuaccggguucgccccuuuuucuaaggauaacagcauccgccuguccgcgggaggcgacaucugggugacaagagagcccuacgucucuugugauccugacaagugcuaucaauucgcucuugggcagggaaccacacugaauaacgugcauagcaauaacaccguucgggaucgcacgccguacagaacacuccugaugaaugagcugggcgugcccuuucaccucgggaccaaacaggucuguauugccugguccucuagcuccugccaugacggaaaggccuggcugcacguguguaucacaggcgaugacaaaaacgcuaccgccagcuucauuuauaauggccggcuuguugauucuguggucuccuggagcaaggaaauccugcgcacccaggagucugaaugcguguguauuaacgggacaugcacgguggucaugaccgacggauccgcuagcggcaaagccgauacaaagauccucuuuaucgaggaggggaagauuguucauaccuccacacugucuggaagcgcgcaacacguggaagagugcuccuguuacccuagauaucccggcgugcggugcgucugucgcgacaacuggaaagggagcaauagaccuaucguggauauuaacaucaaggaccacucuauuguuuccagcuaccuuugcucuggacuggugggcgacacgccccggaaaaaugauagcuccucuagcucccauugucucgacccgaacaaugaagagggcgggcacggagucaagggcugggccuucgaugacgggaacgauguguggaugggacgcaccaucagcgaaaaaucuagacugggcuacgagacauuuaagguuaucgaggggugguccaauccuaaaagcaagcugcagauuaaccgccaggugaucgucgaccggggaaauagaucuggcuauuccggcauuuucagcguggaagggaaguccugcaucaaccgguguuuuuacgucgagcucauuagaggacgcaaagaagagaccgaagugcuguggaccucuaauagcaucguuguguucugcggcacauccgggaccuauggaacaggcucuuggcccgauggggcuaacauuaaucuuaugccuaucuga

SEQ ID NO: 202297 - RNA, 1410 nt, Artificial Sequence
  derived and/or modified sequence opt5 from neuraminidase__InfluenzaA__ADK99077
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagguugugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuagcgaaaagucuagacucggcuaugagacauuuaaagucaucgaggggugguccaaucauaagagcaaacugcagaucaaccgccaggugauugucgaucggggaaauagaucuggcuacuccggcaucuucagcguggaagggaaguccuguauuaaccggugcuuuuauguugagcugaucagaggacgcaaggaagagaccgaagugcucuggaccucuaauagcauugucguguucuguggcacauccgggaccuacggaacaggcucuuggccugacggggcugaucugaaccuuaugcccaucuga

SEQ ID NO: 202298 - RNA, 1410 nt, Artificial Sequence; identical to SEQ ID NO: 202062
  derived and/or modified sequence opt5 from neuraminidase__InfluenzaA__ADK99088

SEQ ID NO: 202299 - RNA, 1410 nt, Artificial Sequence; identical to SEQ ID NO: 201508
  derived and/or modified sequence opt5 from neuraminidase__InfluenzaA__ADK99099

SEQ ID NO: 202300 - RNA, 1410 nt, Artificial Sequence
  derived and/or modified sequence opt5 from neuraminidase__InfluenzaA__ADK99110
augaaccccaaucagaagaucauuaccaucggcagcgugucccugacaauuucuacgaucugcuucuuuaugcaaauugccauccucgucaccacaguuacccugcacuucaaacaguacgaguuuaacccuccgcccaauaaccaggugaugcuuugugaaccuacaaucauugagagaaauaucaccgaaauuguguaucugacaaacaccacgaucgagaaggaaauuugccccaaacucgcugaguaccggaauuggagcaagccucagugugacaucaccggguucgcccccuuuuccaaagauaacucuauucgccugagcgcgggaggcgacaucugggucacaagagagccuuauguguccugcgauccggacaaguguuaccaauucgcucuugggcagggaaccacacugaauaacguucauucuaauaacaccgugcgggaucgcacgcccuauagaacacuccugaugaaugaacugggcgucccuuuucaccucgggaccaaacaggugugcaucgccuggagcuccagcucuugucaugacggaaaggccuggcugcacguuugcauuacaggcgaugacaagaacgcuaccgccuccuucaucuacaauggccggcuuguggauagcgucgugucuugguccaaagacauucugcgcacccaggagagcgaaugugugugcaucaacgggacauguacggucguuaugaccgauggaucugcuuccggcaaggccgacacaaaaauucucuuuaucgaggaggggaagaucgugcauaccagcacacuguccggaucugcgcaacacguggaagagugcagcugcuaucccagauacccuggcguccggugugugugccgcgauaacuggaagggguccaauagacccauuguugacaucaacauuaaagaccacagcaucgugucuuccuacgucuguagcggacuugugggcgauaccccgcggaagaaugacucuagcuccucuagccauugccuggauccuaacaaugaagagggcgggcacggaguuaaaggcugggccuucgacgaugggaacgacguguggaugggacgcacgauuuccgaaaagagcagacucggcuaugagacauuuaaagucaucgagggguggucuaaucccaaguccaaacugcagaucaaccgccaggugauugucgaucggggaaauagaagcggcuacucuggcaucuucuccguggaaggaaagagcuguauuaaccggugcuuuuauguugagcugaucagagggcgcaaggaagagaccgaagugcucuggaccuccaauucuauugucguguucuguggcacaagcgggaccuacggaacaggcuccuggccugacggggcuaacaucaaucugaugcccauuuga

SEQ ID NO: 202301 - RNA, 1410 nt, Artificial Sequence; identical to SEQ ID NO: 202147
  derived and/or modified sequence opt5 from neuraminidase__InfluenzaA__ADK99121

SEQ ID NO: 202302 - RNA, 1410 nt, Artificial Sequence
  derived and/or modified sequence opt5 from neuraminidase__InfluenzaA__ADK99132
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgguggagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagagauucugcgcacccaggaaucugagugugugugcaucaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuaccuuuguucuggacuggucggcgacacgccccggaagaaugauagcuccucuagcucccauugccucgacccgaacaaugaggaaggcgggcacggagugaaaggcugggccuucgaugacgggaacgauguuuggaugggacgcaccauuagcgagaagucuagacugggcuaugagacauuuaaagugaucgaagggugguccaauccuaagagcaaacugcagaucaaccggcaggucauuguggaccgcggaaauagaucuggcuacuccggcaucuucagcgucgaggggaaguccuguauuaaccggugcuuuuauguggaacucaucagaggacgcaaggaggaaaccgagguucuguggaccucuaauagcauuguggucuucuguggcacauccgggaccuacggaacaggcucuuggcccgauggggcugacaucaaccuuaugccuauuuga

SEQ ID NO: 202303 - RNA, 1410 nt, Artificial Sequence; identical to SEQ ID NO: 202147
  derived and/or modified sequence opt5 from neuraminidase__InfluenzaA__ADK99143

SEQ ID NO: 202304 - RNA, 1410 nt, Artificial Sequence; identical to SEQ ID NO: 199623
  derived and/or modified sequence opt5 from neuraminidase__InfluenzaA__ADK99154

SEQ ID NO: 202305 - RNA, 1410 nt, Artificial Sequence
  derived and/or modified sequence opt5 from neuraminidase__InfluenzaA__ADK99176
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugccucaaacuggcugaguaccggaauugguccaagccucagugugacaucaccggguucgcccccuuuucuaaagauaacagcauucgccuuuccgcgggaggcgacaucugggucacaagagagccuuaugugucuugcgaucccgacaaguguuaccaauucgcucuggggcagggaaccacacucaauaacguucauagcaauaacaccgugcgggaucgcacgccuuauagaacacugcugaugaaugaacucggcgucccguuucaccuggggaccaaacaggugugcaucgccugguccagcagcuccugucaugacggaaaggccuggcuucacguuugcauuacaggcgaugacaagaacgcuaccgccagcuucaucuacaauggccggcugguggauucugucguguccuggagcaaagacauucuccgcacccaggagucugaaugugugugcaucaacgggacauguacggucguuaugaccgauggauccgcuagcggcaaggccgacacaaaaauucuguuuaucgaggaggggaagaucgugcauaccuccacacuuucuggaagcgcgcaacacguggaagagugcuccugcuaucccagauacccuggcguccggugugugugccgcgauaacuggaaggggagcaauagacccauuguugacaucaacauuaaagaccacucuaucguguccagcuacgucuguucuggacuggugggcgauaccccucggaagaaugacagcuccucuagcucccauugccucgaucccaacaaugaagagggcgggcacggaguuaaaggcugggccuucgacgaugggaacgacguguggaugggacgcacgauuagcgaaaagucuagacugggcuaugagacauuuaaagucaucgaggggugguccaauccgaagucuaaacugcagaucaaccgccaggugauugucgaucggggaaauagaucuggcuacuccggcaucuucagcguggaagggaaguccuguauuaaccggugcuuuuauguugagcucaucagaggacgcaaggaagagaccgaagugcuguggaccucuaauagcauugucguguucuguggcacauccgggaccuacggaacaggcucuuggccugacggggcuaacaucaaucuuaugcccauuuga

SEQ ID NO: 202306 - RNA, 1410 nt, Artificial Sequence; identical to SEQ ID NO: 202297
  derived and/or modified sequence opt5 from neuraminidase__InfluenzaA__ADK99187

SEQ ID NO: 202307 - RNA, 1410 nt, Artificial Sequence; identical to SEQ ID NO: 201508
  derived and/or modified sequence opt5 from neuraminidase__InfluenzaA__ADK99198

SEQ ID NO: 202308 - RNA, 1410 nt, Artificial Sequence; identical to SEQ ID NO: 202147
  derived and/or modified sequence opt5 from neuraminidase__InfluenzaA__ADK99220

SEQ ID NO: 202309 - RNA, 1410 nt, Artificial Sequence
  derived and/or modified sequence opt5 from neuraminidase__InfluenzaA__ADK99231
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaauuguuaccaauucgcucuugggcagggaaccacacugaacaaugugcauagcaacaauaccguucgggaucgcacgccguauagaacacuccugaugaacgaacugggcgugcccuuucaccucgggaccaagcaggucugcauugccugguccucuagcuccugucaugacggaaaggccuggcugcacgugugcaucacaggcgaugacaaaaaugcuaccgccagcuucauuuacaacggccggcuuguugauucuguggucuccuggagcaaggagauccugcgcacccaggaaucugagugugugugcauuaacgggacauguacgguggucaugaccgacggauccgcuagcggcaaagccgauacaaagauccucuuuaucgaggaagggaaaauuguucauaccuccacacugucuggaagcgcgcaacacguggaggaaugcuccugcuauccuagauaccccggcgugcggugugucugccgcgacaauuggaaggggagcaacagaccuaucguggauauuaauaucaaggaccacucuauuguuuccagcuaccuuuguucuggacuggugggcgacacgccccggaaaaacgauagcuccucuagcucccauugccucgacccgaauaacgaggaaggcgggcacggagucaagggcugggccuucgaugacgggaaugauguguggaugggacgcaccaucagcgagaaaucuagacugggcuaugagacauuuaagguuaucgaagggugguccaacccuaaaagcaagcugcagauuaaucgccaggugaucgucgaccggggaaacagaucuggcuacuccggcauuuucagcguggaggggaaauccuguaucaaucggugcuuuuaugucgaacucauuagaggacgcaaggaggaaaccgaggugcuguggaccucuaacagcaucguuguguucuguggcacauccgggaccuacggaacaggcucuuggcccgauggggcugacauuaaucuuaugccuaucuga

SEQ ID NO: 202310 - RNA, 1410 nt, Artificial Sequence
  derived and/or modified sequence opt5 from neuraminidase__InfluenzaA__ADK99242
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagauuguucauaccuccacacugucuggaagcgcgcaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacgccccggaagaaugacagcuccucuagcucccauugccuggauccgaacaaugaagagggcgggcacggagugaaaggcugggccuucgacgaugggaacgacguuuggaugggacgcaccaucagcgaaaagucuagacucggcuaugagacauuuaaagugaucgaggggugguccaauccuaagagcaaacugcagauuaaccggcaggucaucguggaucgcggaaauagaucuggcuacuccggcauuuucagcgucgaagggaaguccuguaucaaccggugcuuuuauguggagcugauuagaggacgcaaggaagagaccgaaguucucuggaccucuaauagcaucauuguguucuguggcacauccgggaccuacggaacaggcucuuggcccgacggggcugauaucaaccugaugccuaucuga

SEQ ID NO: 202311 - RNA, 1410 nt, Artificial Sequence
  derived and/or modified sequence opt5 from neuraminidase__InfluenzaA__ADK99253
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaaucauaagagcaaacugcagauuaaccggcaggucaucguggaccgcggacacagaucuggcuacuccggcauuuucagcgucgaggggaaguccuguaucaaucggugcuuuuauguggaacugauuagaggacgcaaggaggaaaccgagguucucuggaccucuaacagcaucguggucuucuguggcacauccgggaccuacggaacaggcucuuggccugauggggcugaccugacgcuuaugcccauuuga

SEQ ID NO: 202312 - RNA, 1410 nt, Artificial Sequence
  derived and/or modified sequence opt5 from neuraminidase__InfluenzaA__ADK99264
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuaccuuuguucuggacuggugggcgacacgccccggaagaaugauagcuccucuagcucccauugccucgacccgaacaaugaggaaggcgggcacggagucaaaggcugggccuucgaugacgggaacgauguguggaugggacgcaccaucagcgagaagucuagacugggcuaugagacauuuaaaguuaucgaagggugguccaauccuaagagcaaacugcauauuaaccgccaggugaucgucgaccggggaaauagaucuggcuacuccggcauuuucagcguggaggggaaguccuguaucaaccggugcuuuuaugucgaacucauuagaggacgcaaggaggaaaccgaggugcuguggaccucuaauagcaucguuguguucuguggcacauccgggaccuacggaacaggcucuuggcccgauggggcugacauuaaccuuaugccuaucuga

SEQ ID NO: 202313 - RNA, 1410 nt, Artificial Sequence
  derived and/or modified sequence opt5 from neuraminidase__InfluenzaA__ADK99275
augaaccccaaucagaagaucauuaccaucggcagcgugucccugacaauuucuacgaucugcuucuuuaugcaaauugccguccucaucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcuggguaccggaauugguccaagccccagugugacaucaccggauucgccccuuuuucuaaagauaacagcauucgccuguccgcgggcggggacaucugggucacaagagagcccuaugugucuugcgauccugacaaguguuaccaauucgcucuuggacagggcaccacacugaauaacguucauagcaaugauaccgugcgggaccgcacgccguauagaacacuccugaugaacgagcuggggguccccuuucaccucggaaccaaacaggugugcaucgccugguccucuagcuccugucaugauggcaaggccuggcugcacguuugcauuacaggcgacgauaagaaugcuaccgccagcuucaucuacaacgggcggcuuguggacucugucguguccuggagcaaagaaauucugcgcacccaggagucugaaugugugugcaucaauggaacauguacggucguuaugaccgauggcuccgcuagcgggaaggccgacacaaaaauucucuuuaucgaggagggaaagaucgugcauaccuccacacugucuggcagcgcgcaacacguggaagagugcuccugcuauccuagauaccccgggguccggugugugugccgcgauaacuggaagggaagcaacagaccuauuguugacaucaauauuaaagaccacucuaucguguccagcuacgucuguucuggccuugugggcgauacgccccggaagaacgacagcuccucuagcucccauugccuggauccgaauaacgaagaagggggacacggcguuaaagggugggccuucgacgauggaaaugacguguggaugggccgcaccauuaacgagacaagcagacucggguaugagaccuuuaaggucaucgagggauggucuaauccuaaauccaagcugcagaucaaccgccaggugauugucgaucggggcaauagaagcggcuacucugggaucuucuccguggaaggaaaaagcuguauuaaccggugcuuuuauguugagcugaucagaggccgcaaggaagagaccgaagugcucuggacauccaauucuauugucguguucugugggaccagcggaacauacggcacgggguccuggcccgacggcgcugaucugaaccuuaugccuaucuga

SEQ ID NO: 202314 - RNA, 1410 nt, Artificial Sequence
  derived and/or modified sequence opt5 from neuraminidase__InfluenzaA__ADK99286
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuacaccuagagaacccaccauuaucgagcggaauauuacagaaaucguguaucuuaccaacacgaccauugagaaggaaaucuguccuaaacuggcugaguaccgcaauuggagcaagccccagugcgacauuacaggguucgccccuuuuuccaaagauaacucuaucagacucagcgcgggaggcgacaucugggugacccgggagccguaugucuccugugaucccgacaagugcuaccaauucgcucuggggcagggaacaacccuuaauaacauucauucuaauaacacggugcgcgauagaacaccuuaucggacccugcucaugaaugaacugggcguucccuuucaccuggggacaaaacagguguguaucgccuggagcuccagcucuugccaugacggaaaggccuggcuccacgucuguauuaccggcgaugacaagaacgcuaccgccuccuucaucuacaauggccgccugguggauagcguugugucuugguccaaagagauucuuagaacacaggaaagcgagugcgucuguaucaacgggacgugcaccguggugaugacagacggaucugcuuccggcaaggccgauaccaaaauccuguuuauugaggaagggaagaucguccauacaagcacccucuccggaucugcgcaacacguugaggaauguagcugcuauccucgguaccccggcgugcgcugcguguguagagacaacuggaagggguccaaucggccgauugucgauaucaacauuaaagaccacagcaucgugucuuccuacguuugcagcggacuggugggcgacacgccucgcaagaaugauucuagcuccucuagccauugucuugaccccaacaaugaggaaggcgggcacggagucaaaggcugggccuucgaugacgggaacgauguguggaugggaagaacaaucuccgaaaagagccggcugggcuaugagaccuuuaaaguuauugagggguggucuaauccuaaguccaaacuccagaucaaccgccaggugauugucgacagaggaaaucggagcggcuacucuggcaucuucuccguggagggaaagagcugcauuaacagauguuuuuaugucgaacugauccgcgggcggaaggaggaaaccgaggugcuguggacauccaauucuauuguuguguucugcggcaccagcgggacauacggaacgggcuccuggcccgauggggcugacaucaaccucaugcccaucuga

SEQ ID NO: 202315 - RNA, 1410 nt, Artificial Sequence; identical to SEQ ID NO: 200616
  derived and/or modified sequence opt5 from neuraminidase__InfluenzaA__ADK99297

SEQ ID NO: 202316 - RNA, 1410 nt, Artificial Sequence
  derived and/or modified sequence opt5 from neuraminidase__InfluenzaA__ADK99308
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcauccccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagauuguucauaccuccacacugucuggaagcgcgcaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacgccccggaagaaugacagcuccucuagcucccauugccuggauccgaacaaugaagagggcgggcacggagugaaaggcugggccuucgacgaugggaacgacguuuggaugggacgcaccaucagcgaaaagucuagacucggcuaugagacauuuaaagugaucgaggggugguccaauccuaagagcaaacugcagauuaaccggcaggucaucguggaucgcggaaauagaucuggcuacuccggcauuuucagcgucgaagggaaguccuguaucaaccggugcuuuuauguggagcugauuagaggacgcaaggaagagaccgaaguucucuggaccucuaauagcaucguggucuucuguggcacauccgggaccuacggaacaggcucuuggcccgacggggcuaacauuaaucugaugccuaucuga

SEQ ID NO: 202317 - RNA, 1413 nt, Artificial Sequence; identical to SEQ ID NO: 200485
  derived and/or modified sequence opt5 from neuraminidase__InfluenzaA__ADL14590

SEQ ID NO: 202318 - RNA, 1410 nt, Artificial Sequence; identical to SEQ ID NO: 201508
  derived and/or modified sequence opt5 from neuraminidase__InfluenzaA__ADL27992

SEQ ID NO: 202319 - RNA, 1410 nt, Artificial Sequence; identical to SEQ ID NO: 202147
  derived and/or modified sequence opt5 from neuraminidase__InfluenzaA__ADL28003

SEQ ID NO: 202320 - RNA, 1410 nt, Artificial Sequence; identical to SEQ ID NO: 202292
  derived and/or modified sequence opt5 from neuraminidase__InfluenzaA__ADL28014

SEQ ID NO: 202321 - RNA, 1410 nt, Artificial Sequence
  derived and/or modified sequence opt5 from neuraminidase__InfluenzaA__ADL28025
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaagaaaaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccucuagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuaccuuuguucuggacuggugggcgacacgccccggaaaaaugauagcuccucuagcucccauugccucgacccgaacaaugaagagggcgggcacggagucaagggcugggccuucgaugacgggaacgauguguggaugggacgcaccaucagcgaaaaaucuagacugggcuaugagacauuuaagguuaucgaggggugguccaauccuaaaagcaagcugcagauuaaccgccaggugaucgucgaccggggaaauagaucuggcuacuccggcauuuucagcguggaagggaaguccuguaucaaccggugcuuuuaugucgagcucauuagaggacgcaaagaagagaccgaagugcuguggaccucuaauagcaucguuguguucuguggcacauccgggaccuacggaacaggcucuuggcccgauggggcugacauuaaccuuaugccuaucuga

SEQ ID NO: 202322 - RNA, 1410 nt, Artificial Sequence; identical to SEQ ID NO: 201508
  derived and/or modified sequence opt5 from neuraminidase__InfluenzaA__ADL28036

SEQ ID NO: 202323 - RNA, 1410 nt, Artificial Sequence; identical to SEQ ID NO: 199623
  derived and/or modified sequence opt5 from neuraminidase__InfluenzaA__ADL28047

SEQ ID NO: 202324 - RNA, 1410 nt, Artificial Sequence; identical to SEQ ID NO: 200929
  derived and/or modified sequence opt5 from neuraminidase__InfluenzaA__ADL28058

SEQ ID NO: 202325 - RNA, 1410 nt, Artificial Sequence; identical to SEQ ID NO: 202300
  derived and/or modified sequence opt5 from neuraminidase__InfluenzaA__ADL28069

SEQ ID NO: 202326 - RNA, 1410 nt, Artificial Sequence; identical to SEQ ID NO: 202147
  derived and/or modified sequence opt5 from neuraminidase__InfluenzaA__ADL28080

SEQ ID NO: 202327 - RNA, 1410 nt, Artificial Sequence; identical to SEQ ID NO: 201508
  derived and/or modified sequence opt5 from neuraminidase__InfluenzaA__ADL28091

SEQ ID NO: 202328 - RNA, 1410 nt, Artificial Sequence
  derived and/or modified sequence opt5 from neuraminidase__InfluenzaA__ADL28102
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagacauccugcgcacccaggagucugaaugugugugcauuaacgggacauguacgguggucaugaccgauggauccgcuagcggcaaggccgacacaaaaauccucuuuaucgaggaggggaagauuguucauaccuccacacugucuggaagcgcgcaacacguggaagagugcuccugcuauccuagauaccccggcgugcggugugucugccgcgauaacuggaaggggagcaauagaccuaucguggacauuaacaucaaagaccacucuauuguuuccagcuacguguguucuggacuugucggcgauacgccccggaagaaugacagcuccucuagcucccauugccuggauccgaacaaugaagagggcgggcacggagugaaaggcugggccuucgacgaugggaacgacguuuggaugggacgcaccaucagcgaaaagucuagacucggcuaugagacauuuaaagugaucgaggggugguccaauccuaagagcaaacugcagauuaaccggcaggucaucguggaucgcggaaauagaucuggcuacuccggcauuuucagcgucgaagggaaguccuguaucaaccggugcuuuuauguggagcugauuagaggacgcaaggaagagaccgaaguucucuggaccucuaauagcaucguggucuucuguggcacauccgggaccuacggaacaggcucuuggcccgacggggcugauauuaaccugaugccuaucuga

SEQ ID NO: 202329 - RNA, 1410 nt, Artificial Sequence; identical to SEQ ID NO: 199623
  derived and/or modified sequence opt5 from neuraminidase__InfluenzaA__ADL28113

SEQ ID NO: 202330 - RNA, 1410 nt, Artificial Sequence
  derived and/or modified sequence opt5 from neuraminidase__InfluenzaA__ADL28129
augaaccccaaucagaagaucauuaccaucggcagcgugucccugacaauuucuacgaucugcuucuuuaugcaaauugccauccucgucaccacaguuacccugcacuucaaacaguacgaguuuaacagcccuccgaauaaccaggugaugcuuugugaacccacaaucauugagagaaauaucaccgaaauuguguaucugacaaacaccacgaucgagaaggaaauuugcccuaaacucgcugaguaccggaauugguccaagccccagugugacaucaccggguucgccccuuuuucuaaagauaacagcauucgccuguccgcgggaggcgacaucugggucacaagagagcccuaugugucuugcgauccugacaaguguuaccaauucgcucuugggcagggaaccacacugaauaacguucauagcaauaacaccgugcgggaucgcacgccguauagaacacuccugaugaaugaacugggcguccccuuucaccucgggaccaaacaggugugcaucgccugguccucuagcuccugucaugacggaaaggccuggcugcacguuugcauuacaggcgaugacaagaacgcuaccgccagcuucaucuacaauggccggcuuguggauucugucguguccuggagcaaagacauucugcgcacccaggagucugaaugugugugcaucaacgggacauguacggucguuaugaccgauggauccgcuagcggcaaggccgacacaaaaauucucuuuaucgaggaggggaagaucgugcauaccuccacacugucuggaagcgcgcaacacguggaagagugcuccugcuauccuagauaccccggcguccggugugugugccgcgauaacuggaaggggagcaauagaccuauuguugacaucaacauuaaagaccacucuaucguguccagcuacgucuguucuggacuugugggcgauacgccccggaagaaugacagcuccucuagcucccauugccuggauccgaacaaugaagagggcgggcacggaguuaaaggcugggccuucgacgaugggaacgacguguggaugggacgcaccauuagcgaaaagucuagacucggcuaugagacauuuaaagucaucgaggggugguccaauccuaagagcaaacugcagaucaaccgccaggugauugucgaucggggaaauagaucuggcuacuccggcaucuucagcguggaagggaaguccuguauuaaccggugcuuuuauguugagcugaucagaggacgcaaggaagagaccgaaauucucuggaccucuaauagcaucguggucuucuguggcacauccgggaccuacggaacaggcucuuggcccgacggggcuaacauuaaucugaugccuaucuga

SEQ ID NO: 202331 - RNA, 1410 nt, Artificial Sequence
  derived and/or modified sequence opt5 from neuraminidase__InfluenzaA__ADL28140
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggcaaacuuguugauucuguggucuccuggagcaaggagauccugcggacccaggaaucugagugugugugcauuaacgggacauguacgguggucaugaccgacggauccgcuagcggcaaagccgauacaaagauccucuuuaucgaggaagggaagauuguucauaccuccacacugucuggaagcgcgcaacacguggaggaaugcuccugcuauccucgcuaccccggcgugagaugugucugccgggacaacuggaaagggagcaaucgcccuaucguggauauuaacaucaaggaccacucuauuguuuccagcuacguguguucuggacuugucggcgacacccccagaaagaaugauagcuccucuagcucccauugccuggacccgaacaaugaggaaggcgggcacggagugaaaggcugggccuucgaugacgggaacgauguuuggaugggacggacgaucagcgagaaaucucgccucggcuaugagacauuuaaggugaucgaagggugguccaauccuaaaagcaagcugcagauuaacagacaggucaucguggaccggggaaaucgcucuggcuacuccggcauuuucagcgucgaggggaaguccuguaucaacagaugcuuuuauguggaacugauucggggaagaaaagaggaaaccgagguucucuggaccucuaauagcaucguggucuucuguggcacauccgggaccuacggaacaggcucuuggcccgauggggcuaacauuaaucugaugccuaucuga

SEQ ID NO: 202332 - RNA, 1410 nt, Artificial Sequence; identical to SEQ ID NO: 201508
  derived and/or modified sequence opt5 from neuraminidase__InfluenzaA__ADL28151

SEQ ID NO: 202333 - RNA, 1410 nt, Artificial Sequence; identical to SEQ ID NO: 200929
  derived and/or modified sequence opt5 from neuraminidase__InfluenzaA__ADL28162

SEQ ID NO: 202334 - RNA, 1410 nt, Artificial Sequence; identical to SEQ ID NO: 202147
  derived and/or modified sequence opt5 from neuraminidase__InfluenzaA__ADL28173

SEQ ID NO: 202335 - RNA, 1410 nt, Artificial Sequence; identical to SEQ ID NO: 201508
  derived and/or modified sequence opt5 from neuraminidase__InfluenzaA__ADL28184

SEQ ID NO: 202336 - RNA, 1410 nt, Artificial Sequence
  derived and/or modified sequence opt5 from neuraminidase__InfluenzaA__ADL28195
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcgugaacgggacauguacggucguuaugaccgacggauccgcuagcggcaaggccgauacaaaaauucucuuuaucgaggaagggaagaucgugcauaccuccacacugucuggaagcgcgcaacacguggaggaaugcuccugcuauccuagauaccccggcguccggugugugugccgcgacaacuggaaggggagcaauagaccuauuguugauaucaacauuaaagaccacucuaucguguccagcuacgucuguucuggacuugugggcgacacgccccggaagaaugauagcuccucuagcucccauugccuggacccgaacaaugaggaaggcgggcacggaguuaaaggcugggccuucgaugacgggaacgauguguggaugggacgcaccauuagcgagaagucuagacucggcuaugagacauuuaaagucaucgaagggugguccaauccuaagagcaaacugcagaucaaccgccaggugauugucgaccggggaaauagaucuggcuacuccggcaucuucagcguggaggggaaguccuguauuaaccggugcuuuuauguugaacugaucagaggacgcaaggaggaaaccgaggugcucuggaccucuaauagcauugucguguucuguggcacauccgggaccuacggaacaggcucuuggcccgauggggcugacaucaaccugaugccuauuuga

SEQ ID NO: 202337 - RNA, 1410 nt, Artificial Sequence; identical to SEQ ID NO: 202297
  derived and/or modified sequence opt5 from neuraminidase__InfluenzaA__ADL28206

SEQ ID NO: 202338 - RNA, 1410 nt, Artificial Sequence; identical to SEQ ID NO: 200616
  derived and/or modified sequence opt5 from neuraminidase__InfluenzaA__ADL28217

SEQ ID NO: 202339 - RNA, 1410 nt, Artificial Sequence; identical to SEQ ID NO: 201508
  derived and/or modified sequence opt5 from neuraminidase__InfluenzaA__ADL28228

SEQ ID NO: 202340 - RNA, 1410 nt, Artificial Sequence; identical to SEQ ID NO: 202147
  derived and/or modified sequence opt5 from neuraminidase__InfluenzaA__ADL28239

SEQ ID NO: 202341 - RNA, 1410 nt, Artificial Sequence; identical to SEQ ID NO: 200929
  derived and/or modified sequence opt5 from neuraminidase__InfluenzaA__ADL28250

SEQ ID NO: 202342 - RNA, 1410 nt, Artificial Sequence; identical to SEQ ID NO: 202147
  derived and/or modified sequence opt5 from neuraminidase__InfluenzaA__ADL28261

SEQ ID NO: 202343 - RNA, 1410 nt, Artificial Sequence; identical to SEQ ID NO: 201508
  derived and/or modified sequence opt5 from neuraminidase__InfluenzaA__ADL28373

SEQ ID NO: 202344 - RNA, 1410 nt, Artificial Sequence; identical to SEQ ID NO: 199627
  derived and/or modified sequence opt5 from neuraminidase__InfluenzaA__ADL28387

SEQ ID NO: 202345 - RNA, 1410 nt, Artificial Sequence
  derived and/or modified sequence opt5 from neuraminidase__InfluenzaA__ADL28391
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagucccuuaugugagcugcgaucccgacaaguguuaccaauucgcucuugggcagggaaccacacugaauaacguucauuccaauaacaccgugcgggaucgcacgccuuauagaacacuccugaugaaugagcugggcgucccguuucaccucgggaccaaacaggugugcauugccuggucuagcuccagcugucaugacggaaaggccuggcugcacguuugcaucacaggcgaugacaagaacgcuaccgccucuuucauuuacaauggccggcuuguggauuccaucgucagcuggucuaaagaaauucugcgcacccaggaguccgaaugugugugcaucaacgggacauguacgguggucaugaccgacggaagcgcuuccggcaaggccgauacaaaaauccucuuuauugaggaggggaagaucguucauaccucuacacugagcggauccgcgcaacacguggaagagugcagcugcuaucccagauacccuggcgugcggugugucugccgcgacaacuggaaggggucuaauagacccauuguggauaucaacauuaaagaccacuccaucguuagcucuuacguguguagcggacuugucggcgacaccccucggaagaaugauuccucuagcuccagccauugccuggaccccaacaaugaagagggcgggcacggagugaaaggcugggccuucgaugacgggaacgauguuuggaugggacgcacgaucucugaaaaguccagacucggcuaugagacauuuaaagugauugagggguggagcaauccgaagucuaaacugcagaucaaccggcaggucauuguggaccgcggaaauagauccggcuacagcggcaucuucuccgucgaagggaagucuuguauuaaccggugcuuuuauguggagcugaucagaggacgcaaggaagagaccgaaguucucuggaccagcaauuccauuguggucuucuguggcacaucugggaccuacggaacaggcagcuggccugauggggcugacaucaaccugaugcccaucuga

SEQ ID NO: 202346 - RNA, 1410 nt, Artificial Sequence
  derived and/or modified sequence opt5 from neuraminidase__InfluenzaA__ADL28395
augaaccccaaucagaagaucauuaccaucggcagcgugucccugacaauugccacgaucugcuuccucaugcaaauugcuauccuggucaccacaguuacccuucacuuuaaacaguacgaguguaacucuccuccgaauaaccaggugaugcugugcgaacccgccaucauugagagaaauaucacagaaauuguguaucucaccaacacaaccaucgagaaggaaauuuguccuaaacuggcggaguaccggaauuggagcaagccccagugcaacaucacgggguucgcuccuuuuuccaaagacaauucuauucgccuuagcgccggaggcgauaucugggucaccagagugcccuauguuuccugugacccugauaagugcuaccaauucgcccuggggcagggaacaacccucaacaauggccauucuaacgacacagugcacgaucggaccccguaucgcacgcugcugaugaaugagcucgggguccccuuucaucugggaacaagacagguguguaucgcuuggagcuccagcucuugccacgacggcaaggccuggcuucauguuugugugaccggcgaugacgaaaacgcuacagccuccuucauuuacaaugggcggcuggucgauagcaucggaucuugguccaaaaagauucuccgcacccaggagagcgaaugcguguguaucaacgggaccugcacaguggucaugacggacggcucugcguccggaaaagccgauaccaagauucuguuuaucgaggagggcaaaaucguuaacauuagcacacuuuccgggucugcucaacacguggaagagugcagcuguuauccuagauaccccggagugcggugcgucugucgcgacaauuggaagggcuccaacagaccuaucguggauauuaauguuaaggacuacagcaucgugucuuccuaugucugcagcggccuggugggggacacaccccggaaaaacgauucuuucagcuccucucacugucucgacccgaauaacgaagagggaggccaugggguuaagggaugggccuuugaugacggcaaugauguguggauggggcgcaccauuagcgaaaaauucagauccggauacgagaccuuuaaggucaucgagggcuggagcaaaccuaacucuaagcugcagaucaaucgccaggugauugucgaacggggcaacagauccggguauagcggaaucuucucuguggagggcaaauccugcauuaaucgguguuuuuacguugaacugaucagagggcgcaaggaggaaacggaggugugguggacaagcaacuccauugucguguucugcggaaccucuggcaccuaugggacaggcagcuggcccgacggagcugauaucaaucucaugccuauuuga

SEQ ID NO: 202347 - RNA, 1410 nt, Artificial Sequence; identical to SEQ ID NO: 199762
  derived and/or modified sequence opt5 from neuraminidase__InfluenzaA__ADL29675

SEQ ID NO: 202348 - RNA, 1410 nt, Artificial Sequence; identical to SEQ ID NO: 199762
  derived and/or modified sequence opt5 from neuraminidase__InfluenzaA__ADL29685

SEQ ID NO: 202349 - RNA, 1410 nt, Artificial Sequence
  derived and/or modified sequence opt5 from neuraminidase__InfluenzaA__ADL29695
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacaucgugggcuggucuuggcccgauggggcugagcugccuuucacaaucgacaaguga

SEQ ID NO: 202350 - RNA, 1410 nt, Artificial Sequence; identical to SEQ ID NO: 199762
  derived and/or modified sequence opt5 from neuraminidase__InfluenzaA__ADL29705

SEQ ID NO: 202351 - RNA, 1410 nt, Artificial Sequence; identical to SEQ ID NO: 202349
  derived and/or modified sequence opt5 from neuraminidase__InfluenzaA__ADL29733

SEQ ID NO: 202352 - RNA, 1410 nt, Artificial Sequence; identical to SEQ ID NO: 199762
  derived and/or modified sequence opt5 from neuraminidase__InfluenzaA__ADL29743

SEQ ID NO: 202353 - RNA, 1410 nt, Artificial Sequence
  derived and/or modified sequence opt5 from neuraminidase__InfluenzaA__ADL29753
augaaccccaaucagaagaucauuaccaucggcagcgugugcauggccauugggauggcuaaccugauccuccaaauuggaaauaucaucuccauuuggaucucucacagcauucagcugggcaaccagaaucagaucgagacauguaaccaauccgucauuacguacgaaaauaacaccuggguuaaucagacauaugugaacaucucuaauaccaacuucgccgcggggcagagcguggucuccgugaaacuugcuggaaauucuagccugugcccuguuuccggcugggccauuuacagcaaggacaacucuaucagaaucggguccaaaggagauguguuugucauucgggagccguucaucagcuguucuccccucgaaugccgcacauuuuuccugacccagggcgcccuucugaaugacaagcauuccaacggcacaauuaaagauagaagcccuuaucggacccucaugucuugucccaucggggaggugccuucccccuacaacagccgcuuugaauccguugcuuggucugccagcgcuugccacgacggaauuaauuggcugacgaucggcaucuccgggccugauaacggagccguggcgguccugaaguauaauggcauuaucaccgacacaauuaagagcuggagaaacaauauccuccggacccaagagucugagugugccugcgugaacggguccuguuucacagugaugaccgauggaccgagcgacggccaggcuucuuacaaaauuuuucgcaucgaaaagggcaaaaucgucaagagcguugagaugaaugcccccaacuaucauuacgaagagugcuccuguuacccugauucuagcgagauuacgugcgugugcagagacaauuggcacggguccaaccggcccugggugagcuucaaucagaaccuggaauaucagaucggauacauuuguucuggcaucuuuggggauaauccucgccccaacgacaaaacaggauccugcggcccggucagcucuaauggggcuaacggagugaagggcuucuccuuuaaguauggcaacgggguuuggauuggaagaaccaaaagcaucuccucucggaauggcuucgagaugauuugggauccuaacggguggacaggaaccgacaauaacuuuagcaucaagcaagacaucgugggcauuaaugaaugguccggguacucuggcagcuucguccagcaucccgagcuuaccggacuggauuguauccgcccuugcuucuggguggaacucauuagaggccggcccaaagagaacacaaucuggacguccgggagcucuauuuccuuuuguggaguuaauagcgacaucgugggcuggucuuggcccgauggggccgagcugccuuucaccaucgacaaguga

SEQ ID NO: 202354 - RNA, 1410 nt, Artificial Sequence; identical to SEQ ID NO: 199762
  derived and/or modified sequence opt5 from neuraminidase__InfluenzaA__ADL29763

SEQ ID NO: 202355 - RNA, 1410 nt, Artificial Sequence; identical to SEQ ID NO: 202349
  derived and/or modified sequence opt5 from neuraminidase__InfluenzaA__ADL29773

SEQ ID NO: 202356 - RNA, 1410 nt, Artificial Sequence; identical to SEQ ID NO: 199762
  derived and/or modified sequence opt5 from neuraminidase__InfluenzaA__ADL29783

SEQ ID NO: 202357 - RNA, 1410 nt, Artificial Sequence; identical to SEQ ID NO: 202349
  derived and/or modified sequence opt5 from neuraminidase__InfluenzaA__ADL29882

SEQ ID NO: 202358 - RNA, 1410 nt, Artificial Sequence
  derived and/or modified sequence opt5 from neuraminidase__InfluenzaA__ADL32020
augaaccccaaucagaagaucauuaccaucggcagcgugugcaugacaauugggauggccaaccugauccuccaaauuggaaauaucaucuccacguggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucuauuagaaucggguccaaaggagauguguuugucauccgggagccguucauuagcuguucuccccucgaaugccgcacauuuuuccugacccagggcgcccuucugaaugacaagcauuccaacggcacgaucaaagauagaagcccuuaucggacccucaugucuugucccauuggggaggugccuucccccuacaacagccgcuuugaauccguugccuggucugcuagcgccugccacgacggaaucaauuggcugacaauuggcaucuccgggccugauaacggagcuguggccguccugaaguauaauggcaucauuaccgacacaaucaagagcuggagaaacaauauucuccggacccaagagucugagugugcgugcgugaacggguccuguuucacggugaugacagauggaccgagcgacggccaggccucuuacaaaaucuuucgcauugaaaagggcaaaaucgucaagagcguugagaugaaugcucccaacuaucauuacgaagagugcuccuguuacccugauucuagcgagauuaccugcgugugcagagacaauuggcacggguccaaccggcccugggugagcuucaaucagaaccuggaauaucagaucggauacaucuguucuggcauuuuuggggauaauccucgccccaacgacaaaacaggauccugcggcccggucagcucuaauggggccaacggagugaagggcuucuccuuuaaguauggcaacgggguuuggaucggaagaaccaaaagcauuuccucucggaauggcuucgagaugaucugggauccuaacggguggaccggaacagacaauaacuuuagcauuaagcaagacaucgugggcaucaaugaaugguccggguacucuggcagcuucguccagcaucccgagcuuacgggacuggauuguauucgcccuugcuucuggguggaacucaucagaggccggcccaaagagaacaccauuuggacauccgggagcucuaucuccuuuuguggaguuaauagcgacaccgugggcuggucuuggcccgauggggcugagcugccuuucacaauugacaaguga

SEQ ID NO: 202359 - RNA, 1410 nt, Artificial Sequence; identical to SEQ ID NO: 202349
  derived and/or modified sequence opt5 from neuraminidase__InfluenzaA__ADL32030

SEQ ID NO: 202360 - RNA, 1410 nt, Artificial Sequence; identical to SEQ ID NO: 199762
  derived and/or modified sequence opt5 from neuraminidase__InfluenzaA__ADL32040

SEQ ID NO: 202361 - RNA, 1410 nt, Artificial Sequence; identical to SEQ ID NO: 199762
  derived and/or modified sequence opt5 from neuraminidase__InfluenzaA__ADL32050

SEQ ID NO: 202362 - RNA, 1410 nt, Artificial Sequence; identical to SEQ ID NO: 199762
  derived and/or modified sequence opt5 from neuraminidase__InfluenzaA__ADL32060

SEQ ID NO: 202363 - RNA, 1410 nt, Artificial Sequence; identical to SEQ ID NO: 199762
  derived and/or modified sequence opt5 from neuraminidase__InfluenzaA__ADL32093

SEQ ID NO: 202364 - RNA, 1410 nt, Artificial Sequence; identical to SEQ ID NO: 199762
  derived and/or modified sequence opt5 from neuraminidase__InfluenzaA__ADL32117

SEQ ID NO: 202365 - RNA, 1410 nt, Artificial Sequence; identical to SEQ ID NO: 199762
  derived and/or modified sequence opt5 from neuraminidase__InfluenzaA__ADL32347

SEQ ID NO: 202366 - RNA, 1410 nt, Artificial Sequence
  derived and/or modified sequence opt5 from neuraminidase__InfluenzaA__ADL32357
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaacacgaucuggaccuccgggagcucuauuuccuuuuguggaguuaauagcgacacagugggcuggucuuggcccgauggggcugagcugccuuucaccgucgacaaguga

SEQ ID NO: 202367 - RNA, 1410 nt, Artificial Sequence; identical to SEQ ID NO: 199762
  derived and/or modified sequence opt5 from neuraminidase__InfluenzaA__ADL32367

SEQ ID NO: 202368 - RNA, 1410 nt, Artificial Sequence; identical to SEQ ID NO: 199762
  derived and/or modified sequence opt5 from neuraminidase__InfluenzaA__ADL32377

SEQ ID NO: 202369 - RNA, 1410 nt, Artificial Sequence; identical to SEQ ID NO: 199762
  derived and/or modified sequence opt5 from neuraminidase__InfluenzaA__ADL32387

SEQ ID NO: 202370 - RNA, 1410 nt, Artificial Sequence; identical to SEQ ID NO: 199762
  derived and/or modified sequence opt5 from neuraminidase__InfluenzaA__ADL32397

SEQ ID NO: 202371 - RNA, 1410 nt, Artificial Sequence; identical to SEQ ID NO: 199762
  derived and/or modified sequence opt5 from neuraminidase__InfluenzaA__ADL32407

SEQ ID NO: 202372 - RNA, 1410 nt, Artificial Sequence; identical to SEQ ID NO: 199762
  derived and/or modified sequence opt5 from neuraminidase__InfluenzaA__ADL32417

SEQ ID NO: 202373 - RNA, 1410 nt, Artificial Sequence
  derived and/or modified sequence opt5 from neuraminidase__InfluenzaA__ADL32427
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuaauggggccaacggagugaagggcuucuccuuuaaguauggcaacgggguuuggauuggaagaacaaaaagcaucuccucucggaauggcuucgagaugauuugggauccuaacggguggaccggaaccgacaauaacuuuagcaucaagcaagacaucgugggcauuaaugaaugguccggguacucuggcagcuucguccagcaucccgagcuuacaggacuggauuguauccgcccuugcuucuggguggaacucauuagaggccggcccaaagagaagacgaucuggaccuccgggagcauuaucucuuuuuguggaguuaacuccgacacagugggcuggagcuggcccgauggggcugagcugccuuucaccaucgacaaauga

SEQ ID NO: 202374 - RNA, 1410 nt, Artificial Sequence; identical to SEQ ID NO: 199762
  derived and/or modified sequence opt5 from neuraminidase__InfluenzaA__ADL32447

SEQ ID NO: 202375 - RNA, 1410 nt, Artificial Sequence
  derived and/or modified sequence opt5 from neuraminidase__InfluenzaA__ADL32457
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaaaucuaucagaaucggguccaagggagauguguuugucauucgggagccguucaucagcuguucuccccucgaaugccgcaccuuuuuccugacacagggcgcccuucugaacgacaaacauuccaauggcaccauuaaggauagaagcccuuaucggacgcucaugucuugucccaucggggaggugccuucccccuacaacagccgcuuugaauccguugccuggucugcuagcgccugccacgacggaauuuccuggcugaccaucggcaucagcgggccugauaacggagcuguggccguccugaaguauaauggcauuaucacagacaccauuaaaucuuggagaaacaauauccuccggacacaagaguccgagugugcgugcgugaacgggagcuguuucaccgugaugacggauggaccgucugacggccaggccagcuacaagauuuuucgcaucgaaaaaggcaagaucgucaaauccguugagaugaaugcucccaacuaucauuacgaagagugcucuuguuacccugauagcuccgagauuacaugcgugugcagagacaauuggcacgggagcaaccggcccugggugucuuucaaucagaaccuggaauaucagaucggauacauuuguuccggcaucuuuggggauaauccucgccccaacgacaagaccggaagcugcggcccggucucuuccaauggggccaacggagugaagggcuucagcuuuaaauauggcaaugggguuuggauuggaagaacaaaguccaucucuagccggaacggcuucgagaugauuugggauccuaacggguggaccggaaccgacaauaacuuuuccaucaaacaagacaucgugggcauuaaugaauggucuggguacagcggcuccuucguccagcaucccgagcuuacaggacuggauuguauccgcccuugcuucuggguggaacucauuagaggccggcccaaggagaacacgaucuggaccagcgggucuuccauuagcuuuuguggaguuucuuccgacacagugggcuggagcuggcccgauggggcugagcugccuuucaccaucgacaaauga

SEQ ID NO: 202376 - RNA, 1410 nt, Artificial Sequence; identical to SEQ ID NO: 200939
  derived and/or modified sequence opt5 from neuraminidase__InfluenzaA__ADL32487

SEQ ID NO: 202377 - RNA, 1410 nt, Artificial Sequence; identical to SEQ ID NO: 199762
  derived and/or modified sequence opt5 from neuraminidase__InfluenzaA__ADL32497

SEQ ID NO: 202378 - RNA, 1410 nt, Artificial Sequence; identical to SEQ ID NO: 199762
  derived and/or modified sequence opt5 from neuraminidase__InfluenzaA__ADL32507

SEQ ID NO: 202379 - RNA, 1410 nt, Artificial Sequence; identical to SEQ ID NO: 201224
  derived and/or modified sequence opt5 from neuraminidase__InfluenzaA__ADL32517

SEQ ID NO: 202380 - RNA, 1410 nt, Artificial Sequence; identical to SEQ ID NO: 200939
  derived and/or modified sequence opt5 from neuraminidase__InfluenzaA__ADL32527

SEQ ID NO: 202381 - RNA, 1410 nt, Artificial Sequence; identical to SEQ ID NO: 199762
  derived and/or modified sequence opt5 from neuraminidase__InfluenzaA__ADL32537

SEQ ID NO: 202382 - RNA, 1410 nt, Artificial Sequence; identical to SEQ ID NO: 200649
  derived and/or modified sequence opt5 from neuraminidase__InfluenzaA__ADL32547

SEQ ID NO: 202383 - RNA, 1410 nt, Artificial Sequence; identical to SEQ ID NO: 201113
  derived and/or modified sequence opt5 from neuraminidase__InfluenzaA__ADL32673

SEQ ID NO: 202384 - RNA, 1410 nt, Artificial Sequence; identical to SEQ ID NO: 199762
  derived and/or modified sequence opt5 from neuraminidase__InfluenzaA__ADL32683

SEQ ID NO: 202385 - RNA, 1410 nt, Artificial Sequence; identical to SEQ ID NO: 199752
  derived and/or modified sequence opt5 from neuraminidase__InfluenzaA__ADL32693

SEQ ID NO: 202386 - RNA, 1410 nt, Artificial Sequence; identical to SEQ ID NO: 200985
  derived and/or modified sequence opt5 from neuraminidase__InfluenzaA__ADL32703

SEQ ID NO: 202387 - RNA, 1410 nt, Artificial Sequence; identical to SEQ ID NO: 199752
  derived and/or modified sequence opt5 from neuraminidase__InfluenzaA__ADL32713

SEQ ID NO: 202388 - RNA, 1410 nt, Artificial Sequence; identical to SEQ ID NO: 199762
  derived and/or modified sequence opt5 from neuraminidase__InfluenzaA__ADL32723

SEQ ID NO: 202389 - RNA, 1410 nt, Artificial Sequence; identical to SEQ ID NO: 201443
  derived and/or modified sequence opt5 from neuraminidase__InfluenzaA__ADL32733

SEQ ID NO: 202390 - RNA, 1410 nt, Artificial Sequence; identical to SEQ ID NO: 201443
  derived and/or modified sequence opt5 from neuraminidase__InfluenzaA__ADL32743

SEQ ID NO: 202391 - RNA, 1410 nt, Artificial Sequence
  derived and/or modified sequence opt5 from neuraminidase__InfluenzaA__ADL39139
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuuccgaacccacaauuaucgagagaaauauuaccgaaaucguguaucugacaaacaccacgauugagaaggaaaucuguccuaaacucgcugaguaccggaauuggucuaagccccagugcgacauuaccggguucgccccuuuuagcaaagauaacuccauccgccugucugcgggaggcgacaucugggugacaagagagcccuaugucagcugugauccugacaagugcuaccaauucgcucuugggcagggaaccacacugaauaacgugcauuccaauaacaccguucgggaacgcacgccguauagaacacuccugaugaaugagcugggcgugcccuuucaccucgggaccaagcaggucuguauugccuggucuagcuccagcugccaugauggaaaagccuggcugcacguguguaucacaggcgacgauaagaacgcuaccgccucuuucauuuacaauggccggcuuguugacuccguggucagcuggucuaaagaaauccugcgcacccaggaguccgagugcguguguauuaacgggacaugcacgguggucaugaccgauggaagcgcuuccggcaaggccgacacaaaaauccucuuuaucgaagaggggaagauuguucauaccucuacacugagcggauccgcgcaacacguggaagaguguagcugcuauccuagauaccccggcgugcggugcgucugucgcgauaacuggaaggggucuaauagaccuaucguggacauuaacaucaaagaucacuccauuguuagcucuuacgugugcagcggacuugucggcgacacgccccggaagaaugacuccucuagcuccagccauugucuggauccgaacaaugaagagggcgggcacggagugaaaggcugggccuucgacgaugggaacgacguuuggaugggacgcaccaucucugagaaguccagacucggcuaugaaacauuuaaagugaucgagggguggagcaauccuaagucuaaacugcagauuaaccggcaggucaucguggaucgcggaaauagauccggcuacagcggcauuuucuccgucgaagggaagucuugcaucaaccgguguuuuuauguggagcugauuagaggacgcaaggaagagaccgagguucucuggaccagcaauuccaucguggucuucugcggcacaucugggaccuacggaacaggcagcuggcccgacggggcugauauuaaccugaugccuaucuga

SEQ ID NO: 202392 - RNA, 1413 nt, Artificial Sequence
  derived and/or modified sequence opt5 from neuraminidase__InfluenzaA__ADL39150
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacagagaccaucaaaucuuggaagaaacagauucucagaacgcaggaguccgaaugcguuuguaugaacggcagcugcuuuacaaucaugaccgauggccccucuaauaaggcugccagcuacaaaaucuucaagauugagaaggggaaagugacaaaguccaucgaacugaacgcuccuaauuuuuauuacgaggaguguucuugcuacccggacaccggaauugucaugugugugugccgggauaacuggcauggcagcaaucgccccuggguguccuucaaccagaaucuugacuaucaaaucggguacauuugcagcggagucuuuggcgauaacccuagacccgaagacggggagggaucuuguaauccuguuaccguggauggcgccaacggcgugaaaggguucuccuauaaguacggaaauggcgucuggaucgggcggacaaaaagcaaccgccugagaaagggauuugaaaugauuugggaccccaauggcuggacgaacaccgacucugauuucuccgugaaacaggacguuguggcgaucacagauuggagcggguauuccggcucuuuuguccagcacccggagcucaccggacuggacugcauccggccuuguuucuggguggaacuuguucgcggccugcccagagagaacacaaccauuuggacgagcggguccucuaucagcuucugcggagucaauuccgauacagccaacuggagcuggccugacggcgcugagcuccccuuuaccauugauaaguga

SEQ ID NO: 202393 - RNA, 1410 nt, Artificial Sequence
  derived and/or modified sequence opt5 from neuraminidase__InfluenzaA__ADL39172
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcgaggccgauacaaagauccucuuuaucgaagaggggaaaauuguucauaccuccacacugucuggaagcgcgcaacacguggaagagugcuccugcuauccuagauaccccggcgugcggugugucugccgcgacaacuggaaggggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucagcgagaaaucuagacucggcuaugaaacauuuaaggugaucgaggggugguccaauccuaaaagcaagcugcagauuaaccggcaggucaucguggaccgcggaaauagaucuggcuacuccggcauuuucagcgucgaagggaaauccuguaucaaccggugcuuuuauguggagcugauuagaggacgcaaggaagagaccgagguucucuggaccucuaauagcaucguggucuucuguggcacauccgggaccuacggaacaggcucuuggcccgauggggcugacauuaaccugaugccuaucuga

SEQ ID NO: 202394 - RNA, 1410 nt, Artificial Sequence; identical to SEQ ID NO: 199623
  derived and/or modified sequence opt5 from neuraminidase__InfluenzaA__ADL39183

SEQ ID NO: 202395 - RNA, 1413 nt, Artificial Sequence; identical to SEQ ID NO: 201954
  derived and/or modified sequence opt5 from neuraminidase__InfluenzaA__ADL39194

SEQ ID NO: 202396 - RNA, 1410 nt, Artificial Sequence; identical to SEQ ID NO: 199623
  derived and/or modified sequence opt5 from neuraminidase__InfluenzaA__ADL39205

SEQ ID NO: 202397 - RNA, 1413 nt, Artificial Sequence; identical to SEQ ID NO: 200485
  derived and/or modified sequence opt5 from neuraminidase__InfluenzaA__ADL39227

SEQ ID NO: 202398 - RNA, 1413 nt, Artificial Sequence; identical to SEQ ID NO: 201954
  derived and/or modified sequence opt5 from neuraminidase__InfluenzaA__ADL39238

SEQ ID NO: 202399 - RNA, 1413 nt, Artificial Sequence; identical to SEQ ID NO: 201954
  derived and/or modified sequence opt5 from neuraminidase__InfluenzaA__ADL39249

SEQ ID NO: 202400 - RNA, 1413 nt, Artificial Sequence; identical to SEQ ID NO: 200485
  derived and/or modified sequence opt5 from neuraminidase__InfluenzaA__ADL39260

SEQ ID NO: 202401 - RNA, 1410 nt, Artificial Sequence
  derived and/or modified sequence opt5 from neuraminidase__InfluenzaA__ADL39282
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagaagaauauuaccgaaaucguguaucugacaaacaccacgauugagaaagaaaucugcccuagacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaagguucgggaucgcaccccguauagaacgcuccugaugaaugaacugggcgugcccuuucaccucgggacaaaacaggucugcauugccugguccucuagcuccugucaugacggaaaggccuggcugcacgugugcaucaccggcgaugacaaaaacgcuacagccagcuucauuuacaauggccggcuuguugauucuguggucuccuggagcaaggagauccugcgcacccaggaaucugagugugugugcauuaacgggaccuguacaguggucaugacggacggauccgcuagcggcaaagccgauaccaagauccucuuuaucgaggaagggaagauuguucauacauccacccugucuggaagcgcgcaacacguggaggaaugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacaccccggaaaaaugauagcuccucuagcucccauugccuggacccgaacaaugaggaaggcgggcacggagugaagggcugggccuucgaugacgggaacgauguuuggaugggacgcaccaucagcgagaaaucuagacucggcuaugagacguuuaaggugaucgaagggugguccaauccuaaaagcaagcugcagauuaaccggcaggucaucguggaccgcggaaauagaucuggcuacuccggcauuuucagcgucgaggggaaguccuguaucaaccggugcuuuuauguggaacugauuagaggacgcaaagaggaaacagagguucucuggaccucuaauagcaucguggucuucuguggcaccuccgggacauacggaaccggcucuuggcccgauggggcugacauuaaccugaugccuaucuga

SEQ ID NO: 202402 - RNA, 1413 nt, Artificial Sequence; identical to SEQ ID NO: 200485
  derived and/or modified sequence opt5 from neuraminidase__InfluenzaA__ADL39293

SEQ ID NO: 202403 - RNA, 1410 nt, Artificial Sequence
  derived and/or modified sequence opt5 from neuraminidase__InfluenzaA__ADL39304
augaaccccaaucagaagaucauuaccaucggcagcgugucccugacaauuucuacgaucugcuucuuuaugcaaauugccauccucaucaccacagucacccugcacuucaaacaguacgaguuuaacuucccuccgaauaaccagguuaugcuuugugaacccacaauuaucgagagaaauauuaccgaaaucguguaucugacaaacaccacgauugagaaggaaaucugcccuaaacucgcugaguaccggaauuggagcaagccccagugugacauuaccggguuugccccuuucuccaaagauaacucuauccgccugagcgcgggaggcgacaucugggugacaagagagcccuaugucuccugcgauccugacaaguguuaccaauuugcucuugggcagggaaccacacugaauaacgugcauucuaauaacaccguucgggaucgcacgccguauagaacacuccugaugaaugaacugggcgugcccuuccaccucgggaccaagcaggucugcauugccuggagcuccagcucuugucaugacggaaaagccuggcugcacgugugcaucacaggcgaugacaagaacgcuaccgccuccuuuauuuacaauggccggcuuguugauagcguggucucuugguccaaagagauccugcgcacccaggaaagcgagugugugugcauuaacgggacauguacgguggucaugaccgacggaucugcuuccggcaaggccgauacaaaaauccucuucaucgaggaagggaagauuguucauaccagcacacuguccggaucugcgcaacacguggaggaaugcagcugcuauccuagauaccccggcgugcggugugucugccgcgacaacuggaagggguccaauagaccuaucguggauauuaacaucaaagaccacagcauuguuucuuccuacguguguagcggacuugucggcgacacgccccggaagaaugauucuagcuccucuagccauugccuggacccgaacaaugaggaaggcgggcacggagugaaaggcugggccuuugaugacgggaacgauguuuggaugggacgcaccaucuccgagaaguccagacucggcuaugagacauucaaagugaucgaaggguggucuaauccuaaguccaaacugcagauuaaccggcaggucaucguggaccgcggaaauagaagcggcuacucuggcauuuuuagcgucgagggaaagagcuguaucaaccggugcuucuauguggaacugauuagagggcgcaaggaggaaaccgagguucucuggaccuccaauucuaucguggucuucuguggcacaagcgggaccuacggaacaggcuccuggcccgauggggcugacauuaaccugaugccuaucuga

SEQ ID NO: 202404 - RNA, 1410 nt, Artificial Sequence; identical to SEQ ID NO: 199623
  derived and/or modified sequence opt5 from neuraminidase__InfluenzaA__ADL39326

SEQ ID NO: 202405 - RNA, 1413 nt, Artificial Sequence; identical to SEQ ID NO: 201954
  derived and/or modified sequence opt5 from neuraminidase__InfluenzaA__ADL39392

SEQ ID NO: 202406 - RNA, 1410 nt, Artificial Sequence
  derived and/or modified sequence opt5 from neuraminidase__InfluenzaA__ADL39403
augaaccccaaucagaagaucauuaccaucggcagcgugucccugacaauuucuacgaucugcuucuuuaugcaaauugccauccucaucaccacagucacccugcacuucaaacaguacgaguuuaacccuccgcccaauaaccagguuaugcuuugugaaccuacaauuaucgagagaaauauuaccgaaaucguguaucugacaaacaccacgauugagaaggaaaucugccccaaacucgcugaguaccggaauuggagcaagccucagugugacauuaccggguucgcccccuuuuccaaagauaacucuauccgccugagcgcgggaggcgacaucugggugacaagagagccuuaugucuccugcgauccggacaaguguuaccaauucgcucuugggcagggaaccacacugaauaacgugcauucuaauaacaccguucgggaucgcacgcccuauagaacacuccugaugaaugaacugggcgugccuuuucaccucgggaccaagcaggucugcauugccuggagcuccagcucuugucaugacggaaaagccuggcugcacgugugcaucacaggcgaugacaagaacgcuaccgccuccuucauuuacaauggccggcuuguugauagcguggucucuugguccaaagagauccugcgcacccaggaaagcgagugugugugcauuaacgggacauguacgguggucaugaccgacggaucugcuuccggcaaggccgauacaaaaauccucuuuaucgaggaagggaagauuguucauaccagcacacuguccggaucugcgcaacacguggaggaaugcagcugcuaucccagauacccuggcgugcggugugucugccgcgacaacuggaagggguccaauagacccaucguggauauuaacaucaaagaccacagcauuguuucuuccuacguguguagcggacuugucggcgacaccccgcggaagaaugauucuagcuccucuagccauugccuggacccuaacaaugaggaaggcgggcacggagugaaaggcugggccuucgaugacgggaacgauguuuggaugggacgcacgaucuccgaaaagagcagacucggcuaugagacauuuaaagugaucgagggguggucuaaucauaaguccaaacugcagauuaaccggcaggucaucguggaccgcggaaauagaagcggcuacucuggcauuuucuccgucgagggaaagagcuguaucaaccggugcuuuuauguggaacugauuagagggcgcaaggaggaaaccgagguucucuggaccuccaauucuaucguggucuucuguggcacaagcgggaccuacggaacaggcuccuggcccgauggggcugaccugaaccuuaugccuauuuga

SEQ ID NO: 202407 - RNA, 1413 nt, Artificial Sequence; identical to SEQ ID NO: 200485
  derived and/or modified sequence opt5 from neuraminidase__InfluenzaA__ADL39425

SEQ ID NO: 202408 - RNA, 1413 nt, Artificial Sequence
  derived and/or modified sequence opt5 from neuraminidase__InfluenzaA__ADL39447
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacugaccggcaauuccagccuuuguucuauuuccgggugggcgaucuacacgaaggauaacagcauucggaucggaucuaaaggcgacgucuucgugauucgcgagccuuuuaucuccugcagccaccuggaauguagaaccuucuuucucacacaaggcgcucugcuuaaugauaagcauucuaacgggaccguuaaagaccgguccccguaucgcgcccugaugagcugcccccucggagaggccccuucccccuacaauucuaaguucgaaagcguggcuugguccgccagcgcuugucacgauggcaugggguggcugacaaucggaauuucuggcccugacaacggggccgucgcggugcugaaguauaacggaaucauuaccggcacgaucaaauccuggaagaaacagauucucagaacacaggagagcgagugcguuuguaugaauggcucuugcuuuaccaucaugacagaugggcccagcaacaaggccgcuuccuacaaaaucuucaagauugaaaagggaaaagugaccaagucuaucgagcugaaugccccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuacaguggauggcgcuaauggggugaaaggauucagcuauaaguacggcaacggggucuggaucggacggacgaaaucuaaucgccugagaaagggcuuugagaugauuugggaccccaacggguggaccaauacagacuccgauuucagcgugaaacaggacguuguggccaucaccgauugguccggcuauucuggaucuuuuguccagcacccggaacucacaggccuggacugcauccggccuuguuucuggguggagcuuguucgcgggcugcccagagaaaacaccacgauuuggacauccggaucuagcaucuccuucugcggcgugaacagcgauaccgcgaauuggucuuggccugacggggccgagcuccccuuuaccauugauaaguga

SEQ ID NO: 202409 - RNA, 1413 nt, Artificial Sequence; identical to SEQ ID NO: 200485
  derived and/or modified sequence opt5 from neuraminidase__InfluenzaA__ADL39458

SEQ ID NO: 202410 - RNA, 1413 nt, Artificial Sequence
  derived and/or modified sequence opt5 from neuraminidase__InfluenzaA__ADL39469
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcuggacgcuccuaauuuuuauuacgaagaguguagcugcuacccggauaccggcauugucaugugugugugccgggacaacuggcauggguccaaucgccccugggugagcuucaaccagaaucuugauuaucaaaucggauacauuugcucuggcgucuuuggggacaacccuagacccgaggauggagaaggcuccuguaauccuguuaccguggacggcgccaacggggugaaaggauucagcuauaaguacggcaauggggucuggaucggacggacaaaaucuaaccgccugagaaagggcuuugagaugauuugggaccccaauggguggacgaacaccgauuccgacuucagcgugaaacaggauguuguggcgaucacagacugguccggcuauucuggaucuuuuguccagcacccggaacucaccggccuggauugcauccggccuuguuucuggguggagcuuguucgcgggcugcccagagaaaauacaaccauuuggacguccggaucuagcaucuccuucugcggcgugaacagcgacacagccaacuggucuuggccugauggggcugagcuccccuuuaccauugacaaguga

SEQ ID NO: 202411 - RNA, 1413 nt, Artificial Sequence
  derived and/or modified sequence opt5 from neuraminidase__InfluenzaA__ADL39480
augaaccccaaucagaagaucauuaccaucggcagcauuuccaucgccauugggaucaucucucugaugcuccaaauuggaagcaucauuuccaucugggcuucucacagcauucagacaggcucccagaacaauacggggaucugcaaccagagaauuaucaccuacgagaauagcacaugggugaaccauaccuaugucaauaucaacaauacaaacguuguggccggagaagacaaaaccagcgugacacuggcgggcaauuccagccuuuguucuauuuccgggugggcuaucuacaccaaggauaacagcauucggaucggaucuaaaggcgacgucuucgugauucgcgagccuuuuaucuccugcagccaccuggaauguagaacguucuuucucacccaaggcgcccugcuuaaugauaagcauucuaacgggacaguuaaagaccgguccccguaucgcgcccugaugagcugcccccucggagaggcuccuucccccuacaauucuaaguucgaaagcguggccugguccgcuagcgccugucacgauggcaugggguggcugaccaucggaauuucuggcccugacaacggggcggucgccgugcugaaguauaacggaaucauuacaggcaccaucaaauccuggaagaaacagauucucagaacgcaggagagcgagugcguuuguaugaauggcucuugcuuuacaaucaugaccgaugggcccagcaacaaggcugccuccuacaaaaucuucaagauugaaaagggaaaagugacaaagucuaucgagcugaaugcuccuaacuuuuauuacgaagaguguagcugcuacccggacaccggcauugucaugugugugugccgggauaauuggcauggguccaaccgccccugggugagcuucaaucagaaccuugacuaucaaaucggauacauuugcucuggcgucuuuggggauaauccuagacccgaggacggagaaggcuccuguaacccuguuaccguggauggcgccaauggggugaaaggauucagcuauaaguacggcaacggggucuggaucggacggacaaaaucuaaucgccugagaaagggcuuugagauggugugggaccccaacggguggacgaauaccgacuccgauuucagcguuaaacaggacguggucgcgauuacagauugguccggcuauucuggaucuuuugugcagcacccggaacucaccggccuggacugcauccggccuuguuucuggguugagcuugugcgcgggcugcccagagaaaacacaaccaucuggacguccggaucuagcauuuccuucugcggcgucaacagcgauacagccaauuggucuuggccugacggggcugagcuccccuuuaccaucgauaaguga

SEQ ID NO: 202412 - RNA, 1410 nt, Artificial Sequence
  derived and/or modified sequence opt5 from neuraminidase__InfluenzaA__ADL39491
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucugccccaaacucgcugaguaccggaauuggucuaagccucagugugacauuaccggguucgcccccuuuagcaaagauaacuccauccgccugucugcgggaggcgacaucugggugacaagagagccuuaugucagcugcgaucccgacaaguguuaccaauucgcucuugggcagggaaccacacugaauaacgugcauuccaauaacauuguucgggaucgcaccccuuauagaacgcuccugaugaaugaacugggcgugccguuucaccucgggacaaagcaggucugcaucgccuggucuagcuccagcugucaugacggaaaagccuggcugcacgugugcauuaccggcgaugacaagaacgcuacagccucuuucaucuacaauggccggcuuguugauuccauugugagcuggucuaaagagauccugcgcacccaggaauccgagugugucugcaucaacgggaccuguacaguggugaugacggacggaagcgcuuccggcaaggccgauaccaaaauucucuuuaucgaggaagggaagauuguccauacaucuacccugagcggauccgcgcaacacguugaggaaugcagcugcuaucccagauacccuggcgugcggugugugugccgcgacaacuggaaggggucuaauagacccaucgucgauauuaacaucaaagaccacuccaucgugagcucuuacguuuguagcggacuugugggcgacacaccucggaagaaugauuccucuagcuccagccauugccuggaccccaacaaugaggaaggcgggcacggagucaaaggcugggccuucgaugacgggaacgauguguggaugggacgcaccauuucugagaaguccagacucggcuaugagacguuuaaaguuaucgaaggguggagcaauccgaagucuaaacugcagauuaaccgccaggugaucgucgaccggggaaauagauccggcuacagcggcauuuucuccguggaggggaagucuuguaucaaccggugcuuuuaugucgaacugauuagaggacgcaaggaggaaacagaggugcucuggaccagcuccucuaucguuguguucuguggcaccagcgggacauacggaaccggcuccuggccugauggggcugacaucaaucugaugcccauuuga

SEQ ID NO: 202413 - RNA, 1410 nt, Artificial Sequence; identical to SEQ ID NO: 199762
  derived and/or modified sequence opt5 from neuraminidase__InfluenzaA__ADL41165

SEQ ID NO: 202414 - RNA, 1410 nt, Artificial Sequence
  derived and/or modified sequence opt5 from neuraminidase__InfluenzaA__ADL41175
augaaccccaaucagaagaucauuaccaucggcagcgugugcaugacaauugggauggccaaccugauccuccaaauuggaaauaucaucuccacguggauuucucacagcauccagcugggcaaccagaaucagauugagaccuguaaccaauccgucaucacauacgaaaauaacaccuggguuaaucagacauaugugaacauuucuaauaccaacuucgcugccgggcagagcguggucuccgugaaacuugcgggaaauucuagccugugcccuguuuccggcugggcuaucuacagcaaggacaacucugugagaauuggguccaaaggagaugucuuugugauccgggagccguucaucagcuguucuccccucgaaugccgcacauuuuuccugacccagggcgcccuucugaaugacaagcauuccaacggcacgauuaaagauagaagcccuuaucggacccucaugucuugucccaucggggagguuccuucccccuacaacagccgcuuugaauccguggccuggucugcuagcgccugccacgacggaauuaauuggcugacaaucggcauuuccgggccugauaacggagcugucgccgugcugaaguauaauggcaucaucaccgacacaauuaagagcuggagaaacaauauccuccggacccaagagucugagugugcgugcgugaacggguccuguuucacggucaugacagauggaccgagcaauggccaggccucuuacaaaauuuuucgcaucgaaaagggcaaaauuguuaagagcguggagaugaacgcucccaauuaucauuacgaagagugcuccuguuacccugacucuagcgagauuaccugcgugugcagagauaacuggcacggguccaaucggcccugggucagcuucaaccagaaucuggaauaucagaucggauacaucuguucuggcaucuuuggggacaacccucgccccaaugauaaaacaggauccugcggcccggugagcucuaacggggccaacggaguuaagggcuucuccuuuaaguauggcaaugggguguggauuggaagaaccaaaagcaucuccucucggaacggcuucgagaugauuugggacccuaauggguggaccggaacagauaacaauuuuagcaucaagcaagacauugucggcaucaacgaaugguccggguacucuggcagcuucgugcagcaucccgagcuuacgggacuggacuguauccgcccuugcuucuggguugaacucauuagaggccggcccaaagagaauaccaucuggacauccgggagcucuauuuccuuuuguggagugaacagcgauaccgucggcuggucuuggcccgacggggcugagcugccuuucacaaucgauaaguga

SEQ ID NO: 202415 - RNA, 1413 nt, Artificial Sequence
  derived and/or modified sequence opt5 from neuraminidase__InfluenzaA__ADL60255
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaauuauaccuacgugaacaucaauaacacaaauguuguggccggagaagacaaaaccucugugacacuggcgggcaacagcucccuuuguagcauuucugggugggcuaucuauaccaaggauaauuccauucggaucggaagcaaaggcgacgucuucgugauucgcgagccuuuuaucucuugcucccaucuggaauguagaacguucuuucucacccaaggcgcccugcuuaacgauaagcacagcaaugggacaguuaaagaccggucuccguaccgcgcccugauguccugcccccucggagaggcuccuagccccuauaacuccaaguucgaaucuguggccuggagcgcuuccgccugucaugauggcaugggguggcugaccaucggaauuagcggcccugacaacggggcggucgccgugcugaaguacaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuauaaaaucuucaagauugaaaagggaaaagugacaaaguccaucgagcugaacgcuccuaauuuucacuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccaaagacggacggggcucuuguaauccuguuaccguggauggcgccaacggggugaagggauucuccuauaaauacgacaauggcgucuggaucgggcgcacaaagagcaacagacugcggaaaggauuugagaugauuugggaccccaauggcuggacgaacaccgauucugacuucuccgugaagcaggauguuguggcgaucacagacuggagcggguauuccggcucuuuuguccagcacccggaacucaccggacuggauugcauccgcccuuguuucuggguggagcuuguuagaggccugccccgggaaaacacaaccauuuggacgagcggguccucuaucagcuucugcggagucaauuccgacacagccaacuggagcuggccugauggcgcugagcuccccuuuaccauugacaaguga

SEQ ID NO: 202416 - RNA, 1413 nt, Artificial Sequence
  derived and/or modified sequence opt5 from neuraminidase__InfluenzaA__ADL60277
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaccugugacccuggcgggcaacucuagccuuuguuccaucagcgggugggcuauuuacacaaaagauaauucuauccgcauuggauccaagggcgacgucuucgugaucagagagccguuuaucagcugcucucaccuggaaugucggaccuucuuucucacgcaaggcgcccugcuuaacgauaaacauuccaaugggaccgccaaggaccgcagccccuauagagcucugaugucuugcccucucggagaggcccccuccccuuacaacagcaaauucgaauccguugcuuggucugccagcgcgugucacgauggcaugggguggcugacaauuggaaucuccggccccgacaacggggccguggcuguccugaaguauaauggaauuaucaccggcacaauuaagagcuggaaaaagcagauccuccggacccaggagucugagugcguguguaugaacggcuccugcuuuacgaucaugacagaugggccuagcaauaaagccgcuucuuacaagauuuucaaaaucgaaaagggaaagguuaccaaaagcauugagcugaacgccccgaauuuuuauuacgaagaguguuccugcuaccccgacacaggcaucgugaugugugucugccgcgauaacuggcaugggucuaauagaccuugggugagcuucaaccagaaucuugacuaucaaauuggauacaucugcuccggcguguuuggggauaacccccggccugaggacggagaaggcagcuguaaucccgucaccguugauggcgcgaacggggugaagggauucucuuauaaauacggcaaugggguguggauuggacgcaccaaguccaacagacugcggaaaggcuuugagaugaucugggacccgaauggguggacaaacacggacagcgauuucucugucaagcaggacgugguugccaucaccgauugguccggcuauagcggauccuuugugcagcacccugaacucacaggccuggacugcauucgccccuguuucugggucgagcuugugagagggcugccucgggaaaacaccacaaucuggaccucuggaagcuccauuucuuucugcggcguuaauagcgauacggcuaacugguccuggcccgacggggccgagcuccccuuuacaaucgauaaauga

SEQ ID NO: 202417 - RNA, 1413 nt, Artificial Sequence
  derived and/or modified sequence opt5 from neuraminidase__InfluenzaA__ADL60288
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuuuauuacgaagaguguucuugcuacccggacaccggcauugucaugugugugugccgggauaacuggcaugggagcaaucgccccuggguguccuucaaccagaaucuugacuaucaaaucggauacauuugcagcggcgucuuuggggauaacccuagacccaaagacggaaagggcucuuguaauccuguuaccguggauggcgccaacggggugaaaggauucuccuauaaguacggcaauggggucuggaucggacggacaaaaagcaaccgccugagaaagggcuuugagaugauuugggaccccaauggguggacgaacaccgacucugauuucuccgugaagcaggacguuguggcgaucacagauuggagcggcuauuccggaucuuuuguccagcacccggaacucaccggccuggacugcauccggccuuguuucuggguggagcuuguucgcgggcugcccagagaaaacacaaccauuuggacgagcggauccucuaucagcuucugcggcgucaauuccgauacagccaacuggagcuggccugacggggcugagcuccccuuuaccauugauaaauga

SEQ ID NO: 202418 - RNA, 1413 nt, Artificial Sequence
  derived and/or modified sequence opt5 from neuraminidase__InfluenzaA__ADL60299
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucucuaucaacaauacaaacguuguggccggaaaagacaagaccagcgugacacuggcgggcaauuccagccuuuguucuauuuccgggugggcuaucuacaccaaagauaacagcauucggaucggaucuaagggcgacgucuucgugauucgcgaaccuuuuaucuccugcagccaccuggaguguagaacguucuuucucacccaaggcgcccugcuuaaugauaaacauucuaacgggacaguuaaggaccgguccccguaucgcgcccugaugagcugcccccucggagaagcuccuucccccuacaauucuaaguucgagagcguggccugguccgcuagcgccugucacgauggcaugggguggcugaccaucggaauuucuggcccugacaacggggcggucgccgugcugaaauauaacggaaucauuacaggcaccaucaaguccuggaaaaagcagauucucagaacgcaggaaagcgagugcguuuguaugaauggcucuugcuuuacaaucaugaccgaugggcccagcaacaaagcugccuccuacaagaucuucaagauugagaaaggaaaggugacaaaaucuaucgaacugaaugcuccuaacuuuuauuacgaggaauguagcugcuacccggacaccggcauugucaugugugugugccgggauaauuggcauggguccaaccgccccugggugagcuucaaucaggaccuugauuaucaaaucggauacauuugcucuggcgucuuuggggacaacccuagacccaaggauggaaaaggcuccuguaauccuguuaccguggacggcgccaacggggugaagggauucagcuauaaauacggcaauggggucuggaucggacggacaaagucuaaccgccugagaaagggcuuugagaugauuugggaccccaauggguggacgaacaccgauuccgacuucagcgugaaacaggauguuguggcgaucacagacugguccggcuauucuggcagcuuuguccagcacccggagcucaccggacuggauugcauccggccuuguuucuggguggaacuuguucgcgggcugcccagagagaauacaaccauuuggacguccggaucuagcaucuccuucugcggcgugaacagcgacacagccaacuggucuuggccugauggggcugaacuccccuuuaccauugacaaguga

SEQ ID NO: 202419 - RNA, 1413 nt, Artificial Sequence; identical to SEQ ID NO: 199656
  derived and/or modified sequence opt5 from neuraminidase__InfluenzaA__ADL60310

SEQ ID NO: 202420 - RNA, 1413 nt, Artificial Sequence
  derived and/or modified sequence opt5 from neuraminidase__InfluenzaA__ADL60321
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauggucaugugugugugccgggauaacuggcacgggagcaaucgccccuggguguccuucaaccagaaucuugacuaccaaauuggauauaucugcagcggcgucuuuggggauaacccuagacccgaggacggagaaggcucuuguaauccuguuaccguggauggcgccaacggggugaaaggauucuccuacaaguaugacaauggcgucuggauugggcggacaaaaagcaaccgccugagaaagggauuugagaugaucugggaccccaauggcuggacgaacaccgauucugacuucuccgugaaacaggauguuguggcgauuacagacuggagcggguacuccggcucuuuuguccagcacccggaacucaccggacuggauugcauccggccuuguuucuggguggagcuuguucgcggccugcccagagaaaacacaaccaucuggacgagcggguccucuauuagcuucugcggagucaauuccgacacagccaacuggagcuggccugauggcgcugagcuccccuuuaccaucgacaaguga

SEQ ID NO: 202421 - RNA, 1413 nt, Artificial Sequence
  derived and/or modified sequence opt5 from neuraminidase__InfluenzaA__ADL60332
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugugaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaguuaaagaccggucuccguaucgcgcccugauguccugcccccucggagaggcuccuagccccuacaacuccaaguucgaaucuguggccuggagcgcuuccgccugucacgauggcaugggguggcugaccaucggaauuagcggcccugacaacggggcggucgccgugcugaaguauaauggaaucauuacaggcaccaucaaaucuuggaagaaacagauucucagaacgcaggaguccgagugcguuuguaugaacggcagcugcuuuacaaucaugaccgaugggcccucuaauaaggcugccagcuacaaaaucuucaagauugaaaagggaaaagugacaaaguccaucgagcugaacgcuccuaauuuucauuaugaagaguguucuugcuacccggacaccggcauugucaugugugugugccgggauaacuggcacgggagcaaucgccccuggguguccuucaaccagaaucuugacuaccaaaucggauauauuugcagcggcgucuuuggggauaacccuagacccaaagacggacggggcucuuguaauccuguuaccguggauggcgccaacggggugaagggauucuccuacaaauaugacaauggcgucuggaucgggcgcacaaagagcaacagacugcggaaaggauuugagaugauuugggaccccaauggcuggacgaacaccgauucugacuucuccgugaagcaggauguuguggcgaucacagacuggagcggguacuccggcucuuuuguccagcacccggaacucaccggacuggauugcauccgcccuuguuucuggguggagcuuguuagaggccugccccgggaaaacacaaccauuuggacgagcggguccucuaucagcuucugcggagucaauuccgacacagccaacuggagcuggccugauggcgcugagcuccccuuuaccauugacaaguga

SEQ ID NO: 202422 - RNA, 1413 nt, Artificial Sequence; identical to SEQ ID NO: 199656
  derived and/or modified sequence opt5 from neuraminidase__InfluenzaA__ADL60343

SEQ ID NO: 202423 - RNA, 1413 nt, Artificial Sequence
  derived and/or modified sequence opt5 from neuraminidase__InfluenzaA__ADL60354
augaaccccaaucagagaaucauuaccaucggcagcauuuccaucgccauugggaucaucucucugaugcuccaaauuggaaacaucauuagcaucugggcuucccacucuauucagaucggcagccagaauaacacagggauuugcaaucagcggaucaucacguacgagaacuccaccugggugaaucauacauaugucaacauuaauaacaccaauguuguggccggagaagacaagacaucugugacccuggcgggcaacagcucccuuuguagcaucucugggugggcuauuuacacaaaagauaauuccauccgcauuggaagcaagggcgacgucuucgugaucagagagccuuuuaucucuugcucccaccuggaaugucggaccuucuuucucacgcaaggcgcccugcuuaacgauaaacauagcaaugggaccgccaaggaccgcucuccguauagagcucugauguccugcccccucggagaggccccuagccccuacaacuccaaauucgaaucuguugcuuggagcgccuccgcgugucacgauggcaugggguggcugacaauuggaaucagcggcccugacaacggggccguggcuguccugaaguauaauggaauuaucaccggcacaauuaagucuuggaaaaagcagauccuccggacccaggaguccgagugcguguguaugaacggcagcugcuuuacgaucaugacagaugggcccucuaauaaagccgcuagcuacaagauuuucaaaaucgaaaagggaaagguuaccaaauccauugagcugaacgccccuaauuuuuauuacgaagaguguucuugcuacccggacacaggcaucgugaugugugucugccgcgauaacuggcaugggagcaauagacccuggguguccuucaaccagaaucuugacuaucaaauuggauacaucugcagcggcguguuuggggauaacccucggcccaaggacggaaaaggcucuuguaauccugucaccguugauggcgcgaacggggugaagggauucuccuauaaauacggcaaugggguguggauuggacgcaccaagagcaacagacugcggaaaggcuuugagaugaucugggaccccaauggguggacaaacacggacucugauuucuccgucaagcaggacgugguugccaucaccgauuggagcggcuauuccggaucuuuugugcagcacccggaacucacaggccuggacugcauucgcccuuguuucugggucgagcuugugagagggcugccccgggaaaacaccacaaucuggaccagcggauccucuauuagcuucugcggcguuaauuccgauacggcuaacuggagcuggccugacggggccgagcuccccuuuacaaucgauaaguga

SEQ ID NO: 202424 - RNA, 1410 nt, Artificial Sequence
  derived and/or modified sequence opt5 from neuraminidase__InfluenzaA__ADL60365
augaaccccaaucagaagaucauuaccaucggcagcgugucccugacaauuucuacgaucugcuucuuuaugcaaauugccauccucaucaccacagucacccugcacuucaaacaguacgaguuuaacagcuccccuaauaaccagguuaugcuuugugaaccgacaauuaucgagagaaauauuaccgaaaucguguaucugacaaacaccacgauugagaaggaaaucucucccaaacucgcugaguaccggaauuggagcaagccucagugcgacauuaccggguucgcccccuuuuccaaagauaacucuauccgccugagcgcgggaggcgacaucugggugacaagagagccuuaugucuccugugaucccgacaagugcuaccaauucgcucuugggcagggaaccacacugaauaacgugcauagcaauaacauuguucgggaucgcaccccuuauagaacgcuccugaugaaugaacugggcgugccguuucaccucgggacaaagcaggucuguaucgccuggucuuccagcucuugccaugacggaaaagccuggcugcacguguguauuaccggcgaugacaagaacgcuacagccuccuucaucuacaauggccggcuuguugauagcauugugucuugguccaaagagauccugcgcacccaggaaagcgagugcgucuguaucaacgggaccugcacaguggugaugacggacggauccgcuucuggcaaggccgauaccaaaauucucuuuaucgaggaagggaagauuguccauacaagcacccuguccggaagcgcgcaacacguugaggaauguucuugcuaucccagauacccuggcgugcggugcgugugucgcgacaacuggaagggguccaauagacccaucgucgauauuaacaucaaagaccacagcacagugucuagcuacguuugcuccggacuugugggcgacaccccucggaagaaugauucuagcuccagcucucauugucuggaccccaacaaugaggaaggcgggcacggagucaaaggcugggccuucgaugacgggaacgauguguggaugggacgcacgaucuccgaaaagagcagacucggcuaugagacauuuaaaguuauugagggguggucuaauccgaaguccaaacugcagaucaaccgccaggugauugucgaccggggaaauagaagcggcuacuccggcaucuucucuguggagggaaagagcugcauuaaccgguguuuuuaugucgaacugaucagagggcgcaaggaggaaaccgaggugcucuggaccuccaauucuauuguuguguucugcggcacaagcgggaccuacggaacaggcuccuggccugauggggcugacaucaaccugaugcccaucuga

SEQ ID NO: 202425 - RNA, 1413 nt, Artificial Sequence
  derived and/or modified sequence opt5 from neuraminidase__InfluenzaA__ADL60376
augaaccccaaucagaagaucauuaccaucggcagcauuuccaucgccauugggaucaucucucugaugcuccaaauuggaaacaucauuagcaucugggcuucccacucuauucagacaggcagccagaauaacacggggaucugcaaucagagaauuaucaccuacgagaacuccacaugggugaaucauaccuaugucaacaucaauaacacaaauguuguggccggagaagacaaaaccucugugacacuggcgggcaacagcucccuuuguagcauuucugggugggcuaucuacaccaaggauaauuccauucggaucggaagcaaaggcgacgucuucgugauucgcgagccuuuuaucucuugcucccaccuggaauguagaacguucuuucucacccaaggcgcccugcuuaacgauaagcauagcaaugggacaggaaaagaccggucuccguaucgcgcccugauguccugcccccucggcgaggcuccuagccccuacaacuccaaguucgaaucuguugccuggagcgcuuccgccugucacgaugggaugggauggcugaccaucggcauuagcgggccugacaacggagcgguggccguccugaaguauaauggcaucauuacaggcaccaucaaaucuuggaagaaacagauucucagaacgcaggaguccgagugcguguguaugaacgggagcugcuuuacaaucaugaccgauggacccucuaauaaggcugccagcuacaaaaucuucaagauugaaaagggcaaaguuacaaaguccaucgagcugaacgcuccuaauuuucauuaugaagaguguucuugcuacccggacaccgggauugugaugugugucugccgggauaacuggcacggaagcaaucgccccuggguguccuucaaccagaaucuugacuaccaaaucggcuauauuugcagcgggguguuuggagauaacccuagacccaaagacggcaagggcucuuguaauccugucaccguugauggggccaacggagugaaaggcuucuccuacaaguaugacaaugggguguggaucggacggacaaaaagcaaccgccugagaaagggcuuugagaugauuugggaccccaauggguggacgaacaccgauucugacuucuccgucaagcaggaugugguugcgaucacagacuggagcggcuacuccggaucuuuugugcagcacccggaacucaccggccuggauugcauccggccuuguuucugggucgagcuugugcgcgggcugcccagagaaaacacaaccauuuggacgagcggauccucuaucagcuucugcggcguuaauuccgacacagccaacuggagcuggccugauggggcugagcuccccuuuaccauugacaaauga

SEQ ID NO: 202426 - RNA, 1410 nt, Artificial Sequence; identical to SEQ ID NO: 199762
  derived and/or modified sequence opt5 from neuraminidase__InfluenzaA__ADM07137

SEQ ID NO: 202427 - RNA, 1410 nt, Artificial Sequence; identical to SEQ ID NO: 199762
  derived and/or modified sequence opt5 from neuraminidase__InfluenzaA__ADM07146

SEQ ID NO: 202428 - RNA, 1410 nt, Artificial Sequence; identical to SEQ ID NO: 199762
  derived and/or modified sequence opt5 from neuraminidase__InfluenzaA__ADM07156

SEQ ID NO: 202429 - RNA, 1410 nt, Artificial Sequence; identical to SEQ ID NO: 199762
  derived and/or modified sequence opt5 from neuraminidase__InfluenzaA__ADM07165

SEQ ID NO: 202430 - RNA, 1413 nt, Artificial Sequence; identical to SEQ ID NO: 200485
  derived and/or modified sequence opt5 from neuraminidase__InfluenzaA__ADM07474

SEQ ID NO: 202431 - RNA, 1413 nt, Artificial Sequence; identical to SEQ ID NO: 200485
  derived and/or modified sequence opt5 from neuraminidase__InfluenzaA__ADM07485

SEQ ID NO: 202432 - RNA, 1410 nt, Artificial Sequence
  derived and/or modified sequence opt5 from neuraminidase__InfluenzaA__ADM07496
augaaccccaaucagaagaucauuaccaucggcagcgugucccugacaauuucuacgaucugcuucuuuaugcaaauugccauccucaucaccacagucacccugcacuucaaacaguacgaguuuaacagcccuccgaauaaccagguuaugcuuugugaacccacaauuaucgagagaaauauuaccgaaaucguguaucugacaaacaccacgauugagaaggaaaucugcccuaaacucgcugaguaccggaauugguccaagccccagugugacauuaccggguucgccccuuuuucuaaagauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugaacugggcgugcccuuucaccucgggaccaagcaggucugcauugccugguccucuagcuccugucaugacggaaaagccuggcugcacgugugcaucacaggcgaugacaagaacgcuaccgccagcuucauuuacaauggccggcuuguugauucuguggucuccuggagcaaagagauccugcgcacccaggaaucugagugugugugcauuaacgggacauguacgguggucaugaccgacggauccgcuagcggcaaggccgauacaaaaauccucuuuaucgaggaagggaagauuguucauaccuccacacugucuggaagcgcgcaacacguggaggaaugcuccugcuauccuagauaccccggcgugcggugugucugccgcgacaacuggaaggggagcaauagaccuaucguggauauuaacaucaaagaccacucuauuguuuccagcuacguguguucuggacuugucggcgacacgccccggaagaaugauagcuccucuagcucccauugccuggacccgaacaaugaggaaggcgggcacggagugaaaggcugggccuucgaugacgggaacgauguuuggaugggacgcaccaucagcgagaagucuagacucggcuaugagacauuuaaagugaucgaagggugguccaauccuaagagcaaacugcagauuaaccggcaggucaucguggaccgcggaaauagaucuggcuacuccggcauuuucagcgucgaggggaaguccuguaucaaccggugcuuuuauguggaacugauuagaggacgcaaggaggaaaccgagguucucuggaccucuaauagcaucguggucuucuguggcacauccgggaccuacggaacaggcucuuggcccgauggggcugacauuaacaucaugccuaucuga

SEQ ID NO: 202433 - RNA, 1410 nt, Artificial Sequence
  derived and/or modified sequence opt5 from neuraminidase__InfluenzaA__ADM07507
augaaccccaaucagaagaucauuaccaucggcagcgugucccugacaauuucuacgaucugcuucuuuaugcaaaccgccauucucaucacaaccgucacacugcacuucaaacaguuugaguucaacagcccuccgaauaaccagguuaugcuuugugaacccgcuaucauugagagaaauaucaccgaaauuguguaccugacaaacaccacgaucgagaaggaaauuugcccuaaacucgccgaguaucggaauugguccaagccccagugugacaucaccggguuugcgccuuucucuaaagauaacagcauucgccuguccgcuggaggcgacaucugggugacaagagagcccuacgucucuugcgauccugacaaguguuaucaauuugcccuugggcagggaaccacacugaauaacgugcauagcaauaacaccguucgggaucgcacgccguacagaacacuccugaugaaugaacugggcgugcccuuccaccucgggaccaagcaggucugcaucgccugguccucuagcuccugucaugacggaaaggcuuggcugcacgugugcauuacaggcgaugacaaaaacgccaccgcuagcuuuaucuauaauggccggcuuguugauucuguggucuccuggagcaaagagauucugcgcacccaggaaucugagugugugugcaucaacgggacauguacgguggucaugaccgacggauccgccagcggcaaggcggauacaaaaauucucuucaucgaggaagggaagaucguucauaccuccacacugucuggaagcgcccaacacguggaggaaugcuccugcuacccuagauaucccggcgugcggugugucugccgcgacaacuggaaggggagcaauagaccuauuguggauaucaacauuaaagaccacucuaucguuuccagcuacguguguucuggacuugucggcgacacgccccggaagaaugauagcuccucuagcucccauugccuggacccgaacaaugaggaaggcgggcacggagugaaaggcugggcuuuugaugacgggaacgauguuuggaugggacgcaccauuagcgagaagucuagacucggcuacgagacauucaaagugaucgaagggugguccaauccuaagagcaaacugcagaucaaccggcaggucauuguggaccgcggaaauagaucuggcuauuccggcaucuuuagcgucgaggggaaguccuguauuaaccggugcuucuacguggaacugaucagaggacgcaaggaggaaaccgagguucucuggaccucuaauagcauuguggucuucuguggcacauccgggaccuauggaacaggcucuuggcccgauggggccgacaucaaccugaugccuauuuga

SEQ ID NO: 202434 - RNA, 1410 nt, Artificial Sequence
  derived and/or modified sequence opt5 from neuraminidase__InfluenzaA__ADM12820
augaaccccaaucagaagaucauuaccaucggcagcgugucccugacaauuucuacgaucugcuucuuuaugcaaauugccauccucaucaccacagucacccugcacuucaaacaguacaaguuuaacagcccuccgaauaaccagguuaugcuuugugagcccacaauuaucgaaagaaauauuaccgagaucguguaucugacaaacaccacgauugaaaaagagaucugcccuaagcucgcugaauaccggaauugguccaaaccccagugugacauuaccggguucgccccuuuuucuaaggauaacagcauccgccuguccgcgggaggcgacaucugggugacaagagagcccuaugucucuugcgauccugacaaguguuaccaauucgcucuugggcagggaaccacacugaauaacgugcauagcaauaacaccguucgggaucgcacgccguauagaacacuccugaugaaugagcugggcgugcccuuucaccucgggaccaaacaggucugcauugccugguccagcagcuccugucaugacggaaaggccuggcugcacgugugcaucacaggcgaugacaaaaacgcuaccgccagcuucauuuacaauggccggcuuguugauucuguggucuccuggagcaaggaaauccugcgcacccaggagucugaaugugugugcauuaacgggacauguacgguggucaugaccgacggauccgcuagcggcaaagccgauacaaagauccucuuuaucgaggaggggaagauuguucauaccuccacacugucuggaagcgcgcaacacguggaagagugcuccugcuauccuagauaccccggcgugcggugugucugccgcgacaacuggaaagggagcaauagaccuaucguggauauuaacaucaaggaccacucuauuguuuccagcuacguguguucuggacuugucggcgacacgccccggaaaaaugauagcuccucuagcucccauugccuggacccgaacaaugaagagggcgggcacggagugaagggcugggccuucgaugacgggaacgauguuuggaugggacgcaccaucaaugaaacaagcagacucggcuaugagaccuuuaaagugaucgagggguggucuaacccuaaguccaaacugcagauuaaucggcaggucaucguggaccgcggaaacagaagcggcuacucuggcauuuucuccgucgaagggaagucuuguaucaaucggugcuuuuauguggagcugauuagaggacgcaaggaagagaccgaaguucucuggacauccaacucuaucguggucuucuguggcaccagcgggacauacggaacgggcuccuggcccgauggggcugaccugaaucuuaugccuauuuga

SEQ ID NO: 202435 - RNA, 1410 nt, Artificial Sequence; identical to SEQ ID NO: 202434
  derived and/or modified sequence opt5 from neuraminidase__InfluenzaA__ADM12831

SEQ ID NO: 202436 - RNA, 1410 nt, Artificial Sequence; identical to SEQ ID NO: 202434
  derived and/or modified sequence opt5 from neuraminidase__InfluenzaA__ADM12842

SEQ ID NO: 202437 - RNA, 1410 nt, Artificial Sequence; identical to SEQ ID NO: 202434
  derived and/or modified sequence opt5 from neuraminidase__InfluenzaA__ADM12853

SEQ ID NO: 202438 - RNA, 1410 nt, Artificial Sequence; identical to SEQ ID NO: 199762
  derived and/or modified sequence opt5 from neuraminidase__InfluenzaA__ADM12864

SEQ ID NO: 202439 - RNA, 1410 nt, Artificial Sequence; identical to SEQ ID NO: 199762
  derived and/or modified sequence opt5 from neuraminidase__InfluenzaA__ADM12874

SEQ ID NO: 202440 - RNA, 1410 nt, Artificial Sequence; identical to SEQ ID NO: 199762
  derived and/or modified sequence opt5 from neuraminidase__InfluenzaA__ADM12884

SEQ ID NO: 202441 - RNA, 1410 nt, Artificial Sequence
  derived and/or modified sequence opt5 from neuraminidase__InfluenzaA__ADM12894
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccagucuagcuacaaaauuuuucgcaucgaaaagggcaaaaucgucaaguccguugagaugaaugcccccaacuaucauuacgaagagugcucuuguuacccugauagcuccgagauuacaugcgugugcagagacaauuggcacgggagcaaccggcccugggugucuuucaaucagaaccuggaauaucagaucggauacauuuguuccggcaucuuuggggauaauccucgccccaacgacaaaaccggaagcugcggcccggucucuuccaauggggcuaacggagugaagggcuucagcuuuaaguauggcaacgggguuuggauuggaagaacaaaauccaucucuagccggaauggcuucgagaugauuugggauccuaacggguggaccggaaccgacaauaacuuuuccaucaagcaagacaucgugggcauuaaugaauggucuggguacagcggcuccuucguccagcaucccgagcuuacaggacuggauuguauccgcccuugcuucuggguggaacucauuagaggccggcccaaagagaacacgaucuggaccagcgggucuuccauuagcuuuuguggaguuaauucugacacagugggcugguccuggcccgauggggccgagcugccuuucaccaucgacaaguga

SEQ ID NO: 202442 - RNA, 1410 nt, Artificial Sequence; identical to SEQ ID NO: 199762
  derived and/or modified sequence opt5 from neuraminidase__InfluenzaA__ADM12904

SEQ ID NO: 202443 - RNA, 1410 nt, Artificial Sequence
  derived and/or modified sequence opt5 from neuraminidase__InfluenzaA__ADM12914
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggauccugcggcccggucagcucuuauggggccaauggagugaagggcuucuccuuuaaguacggcaacgggguuuggauuggaagaacaaaaagcaucuccucucggaacggcuucgagaugauuugggauccuaauggguggaccggaaccgacaacaauuuuagcaucaagcaagacaucgugggcauuaacgaaugguccggguauucuggcagcuucguccagcaucccgagcuuacaggacuggauuguauccgcccuugcuucuggguggaacucauuagaggccggcccaaagagaauacgaucuggaccuccgggagcucuauuuccuuuuguggaguuaacagcgacacagugggcuggucuuggcccgauggggcugagcugccuuucaccaucgacaaguga

SEQ ID NO: 202444 - RNA, 1410 nt, Artificial Sequence; identical to SEQ ID NO: 199762
  derived and/or modified sequence opt5 from neuraminidase__InfluenzaA__ADM12924

SEQ ID NO: 202445 - RNA, 1410 nt, Artificial Sequence; identical to SEQ ID NO: 199762
  derived and/or modified sequence opt5 from neuraminidase__InfluenzaA__ADM12934

SEQ ID NO: 202446 - RNA, 1410 nt, Artificial Sequence; identical to SEQ ID NO: 199762
  derived and/or modified sequence opt5 from neuraminidase__InfluenzaA__ADM12944

SEQ ID NO: 202447 - RNA, 1410 nt, Artificial Sequence; identical to SEQ ID NO: 199762
  derived and/or modified sequence opt5 from neuraminidase__InfluenzaA__ADM12954

SEQ ID NO: 202448 - RNA, 1410 nt, Artificial Sequence; identical to SEQ ID NO: 199762
  derived and/or modified sequence opt5 from neuraminidase__InfluenzaA__ADM12964

SEQ ID NO: 202449 - RNA, 1410 nt, Artificial Sequence; identical to SEQ ID NO: 201050
  derived and/or modified sequence opt5 from neuraminidase__InfluenzaA__ADM12974

SEQ ID NO: 202450 - RNA, 1410 nt, Artificial Sequence
  derived and/or modified sequence opt5 from neuraminidase__InfluenzaA__ADM12984
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuagaagcuggcggaacaauauccuccgcacacaagagucugagugugcgugcgugaacggguccuguuucaccgugaugacggauggaccgagcgacggccaggccucuuacaagauuuuuagaaucgaaaaaggcaagaucgucaaaagcguugagaugaaugcucccaacuaucauuacgaagagugcuccuguuacccugauucuagcgagauuacaugcgugugccgggacaauuggcacggguccaaccgccccugggugagcuucaaucagaaccuggaauaucagaucggauacauuuguucuggcaucuuuggggauaauccuagacccaacgacaagaccggauccugcggcccggucagcucuaauggggccaacggagugaaaggcuucuccuuuaaguauggcaacgggguuuggauuggacggacaaagagcaucuccucucgcaauggcuucgagaugauuugggauccuaacggguggaccggaaccgacaauaacuuuagcaucaaacaagacaucgugggcauuaaugaaugguccggguacucuggcagcuucguccagcaucccgagcuuacaggacuggauuguaucagaccuugcuucuggguggaacucauucggggccgccccaaggagaacacgaucuggaccuccgggagcucuauuuccuuuuguggaguuaauagcgacacagugggcuggucuuggcccgauggggcugagcugccuuucaccaucgacaaauga

SEQ ID NO: 202451 - RNA, 1410 nt, Artificial Sequence; identical to SEQ ID NO: 199762
  derived and/or modified sequence opt5 from neuraminidase__InfluenzaA__ADM12994

SEQ ID NO: 202452 - RNA, 1410 nt, Artificial Sequence; identical to SEQ ID NO: 199762
  derived and/or modified sequence opt5 from neuraminidase__InfluenzaA__ADM13004

SEQ ID NO: 202453 - RNA, 1410 nt, Artificial Sequence; identical to SEQ ID NO: 199762
  derived and/or modified sequence opt5 from neuraminidase__InfluenzaA__ADM13014

SEQ ID NO: 202454 - RNA, 1410 nt, Artificial Sequence
  derived and/or modified sequence opt5 from neuraminidase__InfluenzaA__ADM13034
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaacuucgcugccgggcagagcguggucuccgugaaacuugcgggaaauucuagccugugcccuguuuccggcugggcuauuuacagcaaggacaacucuaucagaaucggguccaaaggagauguguuugucauucgggagccguucaucagcuguucuccccucgaaugccgcaccuuuuuccugacacagggcgcccuucugaaugacaagcauuccaacggcaccauuaaagauagaagcccuuaucggacgcucaugucuugucccaucggggaggugccuucccccuacaacagccgcuuugaauccguugccuggucugcuagcgccugccacgacggaauuaauuggcugaccaucggcaucuccgggccugauaacggagcuguggccguccugaaguauaauggcauuaucacagacaccauuaagagcuggagaaacaauauccuccggacacaagagucugagugugcgugcgugaacggguccuguuucaccgugaugacggauggaccgagcgacggccaggccucuuacaaaauuuuucgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuucaaucagaaccuggaauaucagaucggauacauuuguucuggcaucuuuggggauaauccucgccccaacgacaaaaccggaaauugcggcccggucuccagcaacggggccaacggagugaagggcuucucuuuuaaguauggcaaugggguuuggauuggaagaacaaaauccaucagcucccggaacggcuucgagaugauuugggauccuaauggguggaccggaaccgacaacaauuuuucuaucaagcaagacaucgugggcauuaacgaauggagcggguacuccggcucuuucguccagcaucccgagcuuacaggacuggauuguauccgcccuugcuucuggguggaacucauuagaggccggcccaaagagaauacgaucuggaccagcggguccagcauuucuuuuuguggaguuaacuccgacacagugggcuggagcuggcccgauggggcugagcugccuuucaccaucgacaaguga

SEQ ID NO: 202455 - RNA, 1410 nt, Artificial Sequence; identical to SEQ ID NO: 201675
  derived and/or modified sequence opt5 from neuraminidase__InfluenzaA__ADM13044

SEQ ID NO: 202456 - RNA, 1410 nt, Artificial Sequence; identical to SEQ ID NO: 200588
  derived and/or modified sequence opt5 from neuraminidase__InfluenzaA__ADM13054

SEQ ID NO: 202457 - RNA, 1410 nt, Artificial Sequence; identical to SEQ ID NO: 200939
  derived and/or modified sequence opt5 from neuraminidase__InfluenzaA__ADM13064

SEQ ID NO: 202458 - RNA, 1410 nt, Artificial Sequence
  derived and/or modified sequence opt5 from neuraminidase__InfluenzaA__ADM13074
augaaccccaaucagaagaucauuaccaucggcagcgugugcaugacaauugggauggccaaccugauccuccaaauuggaaauaucaucuccauuuggaucucucacagcauucagcugggcaaccagaaucagaucgagacguguaaccaauccgucauuaccuacgaaaauaacacauggguuaaucagaccuaugugaacaucucuaauacaaaccuugcugccgggcagagcguggucuccgugaaacuggcgggaaauucuagccucugcccuguuuccggcugggcuauuuacagcaaggacaacucuaucagaaucggguccaaaggagauguguucgucauucgggagccguuuaucagcuguucuccccuggaaugccgcaccuucuuucuuacacagggcgcccugcucaaugacaagcauuccaacggcaccauuaaagauagaagcccuuaucggacgcugaugucuugucccaucggggaggugccuucccccuacaacagccgcuucgaauccguugccuggucugcuagcgccugccacgacggaauuaauuggcugaccaucggcaucuccgggccugauaacggagcuguggccguccucaaguauaauggcauuaucacagacaccauuaagagcuggagaaacaauauccugcggacacaagagucugagugugcgugcgugaacggguccuguuuuaccgugaugacggauggaccgagcgacggccaggccucuuacaaaauuuuccgcaucgaaaagggcaaaaucgucaagagcguugagaugaaugcucccaacuaucauuacgaagagugcuccuguuacccugauucuagcgagauuacaugcgugugcagagacaauuggcacggguccaaccggcccugggugagcuuuaaucagaaccuugaauaucagaucggauacauuuguucuggcaucuucggggauaauccucgccccaacgacaaaaccggauccugcggcccggucagcucuaauggggccaacggagugaagggcuuuuccuucaaguauggcaacgggguuuggauuggaagaacaaaaagcaucuccucucggaauggcuuugagaugauuugggauccuaacggguggaccggaaccgacaauaaguucagcaucaaacaagacaucgugggcauuaacgaaugguccggguacucuggcagcuuuguccagcaucccgagcugacaggacucgauuguauccgcccuugcuucuggguggaacugauuagaggccggcccaaggagaauacgaucuggaccuccgggagcucuauuuccuucuguggaguuaacagcgacacagugggcuggucuuggcccgauggggcugagcuuccuuuuaccaucgacaaauga

SEQ ID NO: 202459 - RNA, 1410 nt, Artificial Sequence; identical to SEQ ID NO: 200939
  derived and/or modified sequence opt5 from neuraminidase__InfluenzaA__ADM13084
